United States Patent 7,745,391 (HUMAN THROMBOSPONDIN POLYPEPTIDE) - sequence listing, part 159

SEQ ID NO: 414100 - DNA, 4003 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414101 - DNA, 3620 bp, Homo sapiens
cggacgcgtgggtcgacccacgcgtccgaaaagaaacctgttcgcttcctatcatgatggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414102 - DNA, 3501 bp, Homo sapiens
ttatttttttactccatccctaattataaccattttcaccacttcgagtgtgttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414103 - DNA, 1102 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaagatcatagctggttgacactccactcatatcataca

SEQ ID NO: 414104 - DNA, 3461 bp, Homo sapiens
  misc_feature (1)..(1): n is a, c, g, or t
  misc_feature (3)..(3): n is a, c, g, or t
ncntgctggaacgactctcttaatcctccaccgctacaagttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcagggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414105 - DNA, 3399 bp, Homo sapiens
ctctttctgtgtgctggtctgcgctgagttttgagttgtcgaggtgacgcggcgcgcgcggagtggggagtagttcgtgtgggtttggtggctacaggtatccgctcgcgcgcggtggtgcgagactgttttctgttccttgcgacgggaagggctaggccgctgtgtgtcgggctcgatggtttggtttgtgtccgcgcgcatcggcgccgtctgctgacgcaggtgttgtggttgttttgctcccgtctgagtgtggctgttctatatgatgctgtggctagtgtgtggttgtcgtgccctgccgtctggctcggttgatctccccgccgccggaggggggtggtggggttttgtttgtgttagatacctactccggcgtactgggggtgtgtctctctccatgaggggtgttttttggagcgtggggctgccgtgggcttgcggtagtatgtaggttgagcgcccgctgtcgatggcggcggctcgcttgttgtaatacaaaacgctcgcgtggtggtggtggacgtctcttgtgcgcgctcgcgggagggggggtggttgttcggggcgggcgcgcgcgcgctcctctctcttgttttttgttttttgtctttgtgttctgtcttgtgttgttttttttttttttttttttttttttttttttttttttttttttttttttttttttttttttttttttttttttttggttttgtcaaatgttttattgagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414106 - DNA, 3489 bp, Homo sapiens
cgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtc

SEQ ID NO: 414107 - DNA, 2137 bp, Homo sapiens
cgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaagattgaataagagaatctgaatagtgcttaacacaaagaagtgctcattaagtttgctgttatttttgttgttatgtgtctaaacaagaacattattttctcaaatcagaatctgggcatactgtgttcaatgtccctggtctaaaagaagcattaagttatgctatgaaaaagcataaaacgcagtgatttttggtcttgaacattctctttaatttggaatctaaaggcttttggaagcagttttgtatagtataaggtatgcagacagaagagagtcaggaggcctcagagccaccagtcccttcccgtgtgatgtggaatgaatcatttgggaaaatatctgagtgcttgaggtcaaagcctctggaatcagactccctggacttaaaccccatcttcagtacttagaaccttgggcaagttacttaatctcagttaagtataaggacatcagtattcatctataaaatcagtacctactacatagttacagtagcagtatctacttcatacttattgggaggattaaacacggtaggagttaaatggatagaaaccatttagcatagtgactggcaaacaggaagtactcaatacatgttaggaactgttattacttcagggttattccgtgacttctctgaatccttttcttctgtcaaatcatgacagcctaccctaccttatggggtttttgtaaggaccagatgatgtcagatgaaagcattctaaaaaaattatagagacaagaggatcacttgagcccaggagttcgagaccagcatgggcaacatggccaaaccttgtctctacaaaaaaaaaaaaaaaaaaaaaaaaaaaaaaagtaaaaattagcggggtgtgatgttgtgtgcctgtggtcccagctactcaggaggcagtggtgggaggatcacttgagcctggtatgtcgaggctgcagtgagctatgatcgtgccactgcactccaaccaggctgaccgagccagaccctatctcaaaaaa

SEQ ID NO: 414108 - DNA, 2359 bp, Homo sapiens
  misc_feature (1)..(1): n is a, c, g, or t
  misc_feature (6)..(6): n is a, c, g, or t
  misc_feature (8)..(8): n is a, c, g, or t
  misc_feature (26)..(26): n is a, c, g, or t
  misc_feature (33)..(33): n is a, c, g, or t
naaacntnacggctaggtacgaggcngggtgtngcaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtc

SEQ ID NO: 414109 - DNA, 2611 bp, Homo sapiens
  misc_feature (1)..(1): n is a, c, g, or t
  misc_feature (32)..(32): n is a, c, g, or t
ntcctctcctctgtggaacccgctgctgtctncctgtcagtgcccgatctggttgcatcccggtcaaccttaactccgccggaccattattcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtc

SEQ ID NO: 414110 - DNA, 2206 bp, Homo sapiens
  misc_feature (17)..(17): n is a, c, g, or t
  misc_feature (19)..(19): n is a, c, g, or t
aagggctggggtaaccngnccctccgatgtacgggaggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtc

SEQ ID NO: 414111 - DNA, 3493 bp, Homo sapiens
cgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaactttttcttttttttcttctctgttttgggggggggaactgatctgggggggggggaaa

SEQ ID NO: 414112 - DNA, 1908 bp, Homo sapiens
cgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggcatgaaacggtgtcgcagtactctggcgtctttattccaggagaggcttcttacaagataaggcactgcgagtcgattgttacgccacacctgtaacaattttctataaacatctcatggccatcaaaaaaccttaaaactcaat

SEQ ID NO: 414113 - DNA, 1328 bp, Homo sapiens
  misc_feature (836)..(836): n is a, c, g, or t
cgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatggtaaaatcctgggccagagattaagttcttgggatgagaaattaaatgctgctgganagacagagtagtgggaatggaatagaacaagaagaaataattaggacagccacgaagcttgtctcaggcttgaattttctagaagtcactacatgatttctgtgtgtgtgtgtgtggtgtgttttaattaaaaacagcatttaaattgctttcctgaaagcactgcgggtgtttaatgcccacttcttgcttctcctctcctgatgactgtagaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctgtttggttccatgtgtgtttaacatgtgcagaagtagcttctctgtttaagtttaataaagttgagtttcaccagtc

SEQ ID NO: 414114 - DNA, 1999 bp, Homo sapiens
cgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaagattgaataagagaatctgaatagtgcttaacacaaagaagtgctcattaagtttgctgttatttttgttgttatgtgtctaaacaagaacattattttctcaaatcagaatctgggcatactgtgttcaatgtccctggtctaaaagaagcattaagttatgctatgaaaaagcataaaacgcagtgatttttggtcttgaacattctctttaatttggaatctaaaggcttttggaagcagttttgtatagtataaggtatgcagacagaagagagtcaggaggcctcagagccaccagtcccttcccgtgtgatgtggaatgaatcatttgggaaaatatctgagtgcttgaggtcaaagcctctggaatcagactccctggacttaaaccccatcttcagtacttagaaccttgggcaagttacttaatctcagttaagtataaggacatcagtattcatctataaaatcagtacctactacatagttacagtagcagtatctacttcatacttattgggaggattaaacacggtaggagttaaatggatagaaaccatttagcatagtgactggcaaacaggaagtactcaatacatgttaggaactgttattacttcagggttattccgtgacttctctgaatccttttcttctgtcaaatcatgacagcctaccctaccttatggggtttttgtaaggaccagatgatgtcagatgaaagcattctaaaaaaattatagagacaagaggatcacttgagcccaggagttcgagaccagcatgggcaacatggccaaaccttgtctctacaaaaaaaaaaaaaaaaaaaaaaaaaaaaaaagtaaaaattagcggggtgtgatgttgtgtgcctgtggtcccagctactcaggaggcagtggtgggaggatcacttgagcctggtatgtcgaggctgcagtgagctatgatcgtgccactgcactccaaccaggctgaccgagccagaccctatctcaaaaaa

SEQ ID NO: 414115 - DNA, 2824 bp, Homo sapiens
gtactttttgattttgtttatattattcagagtcattagaaaagttaatttagttactagacagtagcttttcaaaaagaaaaaattagattactggggtttttttctgtttattttttcagataaaaagtaaggacatagttaagggagaagaagctacccacagggcagaaaaagcatcatgtgaaaggaagaactaccattttcccagtgcacgaatgaaatgactctttgtctctcatttccagtctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtc

SEQ ID NO: 414116 - DNA, 3376 bp, Homo sapiens
cgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtc

SEQ ID NO: 414117 - DNA, 2407 bp, Homo sapiens
  misc_feature (836)..(836): n is a, c, g, or t
cgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatggtaaaatcctgggccagagattaagttcttgggatgagaaattaaatgctgctgganagacagagtagtgggaatggaatagaacaagaagaaataattaggacagccacgaagcttgtctcaggcttgaattttctagaagtcactacatgatttctgtgtgtgtgtgtgtggtgtgttttaattaaaaacagcatttaaattgctttcctgaaagcactgcgggtgtttaatgcccacttcttgcttctcctctcctgatgactgtagaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaagattgaataagagaatctgaatagtgcttaacacaaagaagtgctcattaagtttgctgttatttttgttgttatgtgtctaaacaagaacattattttctcaaatcagaatctgggcatactgtgttcaatgtccctggtctaaaagaagcattaagttatgctatgaaaaagcataaaacgcagtgatttttggtcttgaacattctctttaatttggaatctaaaggcttttggaagcagttttgtatagtataaggtatgcagacagaagagagtcaggaggcctcagagccaccagtcccttcccgtgtgatgtggaatgaatcatttgggaaaatatctgagtgcttgaggtcaaagcctctggaatcagactccctggacttaaaccccatcttcagtacttagaaccttgggcaagttacttaatctcagttaagtataaggacatcagtattcatctataaaatcagtacctactacatagttacagtagcagtatctacttcatacttattgggaggattaaacacggtaggagttaaatggatagaaaccatttagcatagtgactggcaaacaggaagtactcaatacatgttaggaactgttattacttcagggttattccgtgacttctctgaatccttttcttctgtcaaatcatgacagcctaccctaccttatggggtttttgtaaggaccagatgatgtcagatgaaagcattctaaaaaaattatagagacaagaggatcacttgagcccaggagttcgagaccagcatgggcaacatggccaaaccttgtctctacaaaaaaaaaaaaaaaaaaaaaaaaaaaaaaagtaaaaattagcggggtgtgatgttgtgtgcctgtggtcccagctactcaggaggcagtggtgggaggatcacttgagcctggtatgtcgaggctgcagtgagctatgatcgtgccactgcactccaaccaggctgaccgagccagaccctatctcaaaaaa

SEQ ID NO: 414118 - DNA, 354 bp, Homo sapiens
gtatttgctcatttgtgcaaatgaaatagaaaaggtaaatgagaaactcaagaggtttgttacctactgtcaatggagtggggaaaatgggtggaaagaagaaggcaataagaaaagagtaacaggaaacgacagtgacacttctgagtataccttgtggaatctctttcactcttagaatcatagtaatagaagaagaaaaaagaactccccaaactgaaaaggatagaccactggaacaacttcaagtggtctaatgtagaagcaaatggagtccctcaaggaaagaagagaggtttggaaaagaaaaaacatttgaagagttaacagcgaaacactttccaaacttaaagg

SEQ ID NO: 414119 - DNA, 180 bp, Homo sapiens
  misc_feature (1)..(1): n is a, c, g, or t
  misc_feature (128)..(128): n is a, c, g, or t
ngtgggctgggagtcagcctaaaattccattatgaaagactggtaagctaaaaaagtctaccagctaccctaaggagcttaaacttgccttttggtcaaaggaaagccatcaaagaagggaagtggcntaatcagatgtggcctttgtaagactctctggcattgctttagaggaagatt

SEQ ID NO: 414120 - DNA, 390 bp, Homo sapiens
ttttatttgccaaaataaattggtttgcctcaaaccacacactaggtgctaagtatcttcaaagcaaaattcaatgaaacttgaaagtgctataggactgaggttgtaagtgacagaaacccaattcagactaagcagaaagagagctttgtctccaggatccgagggtgcattctggaggcccgagctaggatgtggagcaagggatgtggctgagcccacagtgcagctggaaccagggatgcaaatgccgccaggacctctctgtttctcacctctgcttccatccgcatctctgcctcctccaggccaaattttggtgaacagtgactgtgtccattctttatatctcatcattaaattatgggaagagtcctgcgtgaaagtccg

SEQ ID NO: 414121 - DNA, 454 bp, Homo sapiens
agctttttccactgctacacagggtttttagctttaacctgtgaaaatggactgggttttgacctgggttttagcttgacctgtggaaatggacttgcccttcagatgaatgacgagactgtaaggggttcatttggggattgcaggacacaggtttaccctgtcttagaatataagcatccatgaggcaggaggtcttaaaaaccttttgcagatcttgacatcttatctacacatttcctagtcctcagctgccaaccaaaatctcccaattgctctattacagctcaatgacttacatcaccaagtatggttccattacttctaccagctgaagcaatggaatatgcaatattttattatgcatataattgaaatactttctgttctttctaagttcgaatattgtttgtgtcacatattgttctgagcatgccttggtcacagtcaggtc

SEQ ID NO: 414122 - DNA, 404 bp, Homo sapiens
aatctatacttctcttcaaatgtttgtaccactcacctacccaattcccttcccaccccaatcaaaagacaaatacccatgctcagaacctgggggctcacattttacctgaaattccacaagtaacagaagcacacatttaggggataaaaccctagagagagagtaacacaatcctggctgccatctcagaacaagagagcattgtacccagagtccatgatcacatactggaatgactgtgtgacggagctgacatgccccaataggtacaacagattgttctgcttgtaaccaatcaataccacaattaacaaatatttattgaacaccccggaagcaccctggtatatactgtcctcatcagctatttgttagaataacacgaaacctcctgatcctct

SEQ ID NO: 414123 - DNA, 326 bp, Homo sapiens
gcgattctcctgcctcagcttcctgagtagctgggattacaggtgcctgccaccacgcccgcctaatttttgtatttttagtaaagacagggtttcaccatgttggtcaggctggtctcgaactgctgacctcatgatccacccgcctcagcctcccaaagtgttgggattacaggcatgagccaccaagcccggcaaatccatgcttttaaacattactctgtatggtgtgataatgaacagtcactgtatctgactgttcatctgtgtgtccatctgtattgaataaaggagaaggagttgaagaataaagggaaatctacaga

SEQ ID NO: 414124 - DNA, 458 bp, Homo sapiens
ataaaatttgacaaatatatttgaagcccctatgtgttcaacagtgttagttgttaacttatgttttccttattatatgaggctcaaagacgttaaataacttggtcaagtggagaaagtgccagaattctgcatctgattggctacaaaggctgtgcaccctcttgttgtatacagtgatggctctttttgaaactctctttcttatcattccatgatgtagtggtcctctttttctgtaatctcctggtctctgttgcttattctgctcttaatccttataaaagtgccattttgcttttctgccttgaataacacttccttagtgctgacttttacatggccttatcgatgtcgttgatgttcaagtatgactagaagctgctgctcagttggcattttttattttttcaggtaggtcttactctttcattatcccatctagtttgtcactatag

SEQ ID NO: 414125 - DNA, 232 bp, Homo sapiens
ggtccctgactccagcctgacacgccttcgaaattctgctgccacttggttacacaaagcaccacgacccacccgactctaactggccacaaatgcctttgtcacaggggagcacactttccccctggaaatgcagcggtggaaggacacaggtggtctttgctaaggaatgccttaacagctccccgtcttctctacctagcaacttgatctgtgatgtttttgaaagcct

SEQ ID NO: 414126 - DNA, 802 bp, Homo sapiens
aggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcac

SEQ ID NO: 414127 - DNA, 2523 bp, Homo sapiens
ataaaaaccggccgagcccctaaaggtgcggatgcttattatagatcgacgcgacaccagcgcccggtgccaggttctcccctgaggcttttcggagcgagctcctcaaatcgcatccagattttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcgtcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgaccaccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaaatcggg

SEQ ID NO: 414128 - DNA, 228 bp, Homo sapiens
  misc_feature (90)..(90): n is a, c, g, or t
caaaatcaggaaactgacattggcacaatactcatgtaggattttatctggaagtagttactatcaaaatgaacttaggtgctacttttncaaattaatttagaaattaattttggccttctggcattttgtaaaaagctaataaaactctaaaaatatgttgtcaggctgggcatggtggctcacgcctgtaatcccagcactttgggaggccgaggcgggcggatc

SEQ ID NO: 414129 - DNA, 187 bp, Homo sapiens
gaagaaaaacctcaccccctttttggtcaaaattgtagtaactgatattatttttctttaaaaaataatttgttcagataaagtctaagaaattccctattaatctctcattttttctggacaccagaactttgtaatagaattttattcatacttactcataactacactgaagttggatttatag

SEQ ID NO: 414130 - DNA, 762 bp, Homo sapiens
gaatagcaagggaaagactgacccccatgattcaattacctttccctgggtccctcccacagcacgtgggaattctgtgcgatacaattgaagccgagatctggatggggactcagccaaaccatatcacatgccatttcatttgatccatacaacatggggcaaagatgatcggtttgacaaacagattctaaagggttctggaatcgtctggtcctccagccacaactcaacatggatctcttaagtctaaagttctgtcctgtacctgcagcctcctttggcctagttattttgtgaaatctcatgcttcacagtcgaatctgtgtagaacctgggttaatcacgccagtatgcgatcaatatcctcatctccccatctgctttgtcagtggattctgagggaaaacctgtaaattagagagggatgagccatataagaatgtctccttgtgagtgttcattgtgcagagaaagctgaaaattgcaaaaccctgtaatcatgaaatgaaagagaaggaacatctaagtggtagctttggggtcaggaagagggtagacaaactgtcccaacaccaagcagccatctacatgacccagccacctgatgtggcaccaaatgacccagagtcttgaggttctgaactgttcccagactcggggacaatgtgaggactgggtcttccatgctccttttcactcccactcaccctgagatttttctcaggtggaattaaacagggagccaagtaatagcattct

SEQ ID NO: 414131 - DNA, 335 bp, Homo sapiens
tattttattatatctttcagatatgttataggtgggaaaatccgaataactgcttttatcttggtcaggaaatacagggaattggtgtactggggaagatcacatattacgagacacactttaattacctttgtggagtattacttttctaataaccaaacttgttaaaatgctaaattttatttgtgttttaataacccagattgctaaattgctaaataatctaatatactaaattgctaaaataatgccaaacataattaaactttcatttggttctgaacaattttcagtgtccccaagtcattatcaatattgcattaatgtagaaatct

SEQ ID NO: 414132 - DNA, 470 bp, Homo sapiens
ttttcctttctatacgtgtggtgatgtccaccatctctacatatcaaatctgtaaatcagaaattcagtcaacaagtattcagaatttccagatgtgctgagttttagtaatttaaaatataataaaggcttctgagtttttaatgaattttcgttgtttctaagacaaatgatatttccttcatattttttgaagttttgaatttttatctatttttttcaggtgtttaaacacaggtatgagatatacaggatctcagaaattacttttgaagttcattaaactatttgattgtactttttttcttttgagacagggcctagctttgtcttccagactggagtgtggtggtgtgatcatggctcattgcaacctcgacctcctgaactcaagcaatcctccctcctcagtctcctgaatagctgggactataggcgcaccctatcatgcccagctaattaaaaaaaaa

SEQ ID NO: 414133 - DNA, 268 bp, Homo sapiens
tactagcactaaattagcggccgcgtcggccacaggtatgagatatacaggatctcagaaattacttttgaagttcattaaactatttgattgtactttttttcttttgagacagggcctagctttgtcttccagactggagtgtggtggtgtgatcatggctcattgcaacctcgacctcctgaactcaagcaatcctccctcctcagtctcctgaatagctgggactataggcgcaccctatcatgcccagctaattaaaaaaaaa

SEQ ID NO: 414134 - DNA, 786 bp, Homo sapiens
tccagtttgccaactgagctaagaaatgctggataaaagtaaaagctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccaactaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagccaagaag

SEQ ID NO: 414135 - DNA, 858 bp, Homo sapiens
tagcagtcgcggtgtgccgctacgtgcgggctctcaaggagctcagcctcccggacggagccggcggctgcggggcgaggacggcggcggaccggggcagccccgcgccctggccagctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccaactaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagccaagaag

SEQ ID NO: 414136 - DNA, 691 bp, Homo sapiens
aggcgaggcactgcctggcaaggctgctggagggagatctggccgcagatggtgaaggagaacatcgaggcccccagtccccaagcagggctccatgggtcgggcggcgggcattgctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccaactaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtccggggttgtt

SEQ ID NO: 414137 - DNA, 679 bp, Homo sapiens
gacccagactccgtgaatagagggaaaggcggccagcagaacccaaactgttctgccacaggctcctccccacagagcacagctcagtgcaacagagtccccaaatccaagatgcagaatccacaaagagaaaaccttctgctccagaaggatttccaaagatgatgttaaacccagccacggttctgatctccaggaaagcaattgctgtggtacaaaaggacaagggttaaaagagaacagtgggagctctctttcccaactaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagccaagaag

SEQ ID NO: 414138 - DNA, 494 bp, Homo sapiens
aggcgaggcactgcctggcaaggctgctggagggagatctggccgcagatggtgaaggagaacatcgaggcccccagtccccaagcagggctccatgggtcgggcggcgggcattgctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtccggggttgtt

SEQ ID NO: 414139 - DNA, 540 bp, Homo sapiens
cttgagccactatgcccaaccaccattaagattttggcaggaatcattgtgctagacaccactatcccaccaatcactgagcacttttcatttcctgccgctggtgctgttggataccttacggcaagctgccgtccctgcccacccacctgaggacaggaacctccaactctgccttgccagaactgaccagtgtgtctgacagatggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagccaagaag

SEQ ID NO: 414140 - DNA, 857 bp, Homo sapiens
aggcgaggcactgcctggcaaggctgctggagggagatctggccgcagatggtgaaggagaacatcgaggcccccagtccccaagcagggctccatgggtcgggcggcgggcattgctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccaactaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagccaagaag

SEQ ID NO: 414141 - DNA, 481 bp, Homo sapiens
ctcccccatcaccccaacctacagaggaggatcctgagcacagagtccgggtccgggtcaccaagctccgtctcggaggccctaatcaggatctgactgtcctcgagatcaaacgggaaaacccacagctgaaacagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagccaagaag

SEQ ID NO: 414142 - DNA, 510 bp, Homo sapiens
  misc_feature (20)..(20): n is a, c, g, or t
  misc_feature (104)..(104): n is a, c, g, or t
  misc_feature (272)..(272): n is a, c, g, or t
atcatgaactcgaggcggtnccggggcagggcagagctggcaagcacgtggtggggcccctgaggtgtgcagagggtcgcgcacctagaagcctgtcgctggcncggtctgggcgggaggttctgcggcgggaggcagcctgttggttgcagggctgaaaaagcagttctacaaggcaagccagctggtcagtgagaaggtcggagggtctgaggggaccaagctggacaatgacttcaaagagatggagatgtcatcagcaaggcggtganggaaatgctggcaaggaccatcaagtacctggagcccaacccagcctcacaggctaagctgaccatgctcaacacagtgtgaaagatccagggccaggtgaagaaccccggctacccgcagtcggaggggctcctgagcgagtgcctgatccgccaccagaaggagctgggcaacgagtccaacttcagtgatgcactgctggatgccggcgagtccatgaagcacctggcagaggtg

SEQ ID NO: 414143 - DNA, 678 bp, Homo sapiens
aaggtaaaatttatatacaatgaaatatacaaatcttaagtgcgccatttaatgagttttgacaaatgtatgtgtctacgtaattcaaactgctatcaagaaatggaacatttccatcacctcagaaatttttctcacagccattcccagtcaaaatgtggcaccacccactcctgaggcaaccctgttctggttttccaccacagatttttgccataaaaaattagtacacaggatatgattccattgttcattaaatgggattatatactatgtactactttatgggaagatttttgaaaaatattcagcataatgttttcgagattcatcccacgttgttgcataaaatagcagttcattcctttttatcgctgaggattccatcacatgaatatacgagttcatttatttattctcttattgatggatacatttgggatatttgagtttttgcctatcacgaacaaagttattagccagacatggtggttcatgtctgtcatcccagcactttgggaggctgacgcaggaggatcacttgaagtcaggagtctgagaccagcctgggcaaaatagcaagacacagtctctaccaaaaaaataaaatagttagccagacatggcacctgtagtcctactctggaggctgaggtgggaggatcggttgagtccaga

SEQ ID NO: 414144 - DNA, 1669 bp, Homo sapiens
cgcccgaatgagagcgcggggcggtgccgttgggaccacggcggccagagcggcaggatggcttccggcttcaagaagcccagcgctgcctccaccggccaaaagagaaaggtggcacctaagcccgagctcactgaggatcagaagcaagaagttcgggaagcatttgacctcttcgacgtggacggaagtgggaccatcgacgcgaaggagctgaaggtggccatgagagcgctgggcttcgaacccaggaaggaagagatgaagaaaatgatctccgaggtggacagggaaggcacggggaagatcagcttcaatgacttcctggccgtgatgacgcagaagatgtccgagaaggacaccaaagaagaaatcctgaaggccttcaggctctttgatgacgatgagaccgggaagatctcgttcaaaaacctgaagcgtgtggccaacgagctgggggagaacctcacggatgaggagctgcaggagatgatcgacgaagctgatcgggatggggacggcgaagtgaacgaggaggagttccttcggatcatgaagaagaccagcctttactgaagtcggttcagaagctaaagtgactctctgggttgcctgcttccattttgtgaaaccttagaggacagcggctgcctgtcccttcttcaccccctcacccccataatttgtctagatctatttccatatctctagttcaataatagaatttgaaagatgcttgtaatgtgagttttgggttttaattctcaagagccaacctggagcacatgaggttaaacaaagggccctgaagtttgagtgcgccctccatttgccctgtgctgaacttgctgttcatctgttgatctggaggcaggacagcttctgggacacacaaaaatgtggttccctttgtcacttctttggtggtcttaaattatcttgcttcatatatcattccttaaattccagtcattgttccagcataatgagatggaatctgccagtagatttgcctagcctgtccacttagctgaataccagtttgaaggaaaacagggtggccacttacaaacttacggagctcaggacagatattcttataaagaatagacttgcttgggtggtagtacgttgtgcaattttgactattcactggctttatacctgcaaatgattcttcgttcatgtgtaaattgtccaccatgggtttatctagggctagtatgtatacctgggctacagaataaaaataaaatctaatactggcccaagcaaagtataatttgcttaagaggttacgctaacaaacgattttgagtaaatatttacaaatgtaggatcttagtttaggaaattataacaaataccttaatataacattttaagctacttatagtccttggaaatagcaacaaatatcttagttattggactattataaccttagtcatcttattactgcttgattatgagacactctccctgctaatccttagaacatcttggttcttggtacttgacttttagcccctctgacatatagttgatgtcagagtgtctggcatttcagtagtgctctattttacaaatcccagtaaactgctccactgtggcttgtttatgtgttaatactgcttgttttctgttataaattattttttgctttgga

SEQ ID NO: 414145 - DNA, 345 bp, Homo sapiens
tttaaagaacaatgattaagtgaaaattctctcagttttttttaattggttcagcaattgattaattactgaatcttgaccctaaactttttagtctagaaatgtgcttgaggaatacaggctggagatcagctttttgacattgcattcccctcctggatcacatccatgttggaatcaatttataaactgccttcctaaggcttaaaatgatggtgatctacagacaagtgccttcctaggcacagggttgctggagactgatgccaggcccatggctcttaaagggaacactgaactcatggcagaaatggtggaaagtagagaaatgaatagagggggaaa

SEQ ID NO: 414146 - DNA, 1007 bp, Homo sapiens
aacgcagaggatgagtccatcccttcttcccaggaggagggaaaaggggtacaaatggggctcccactggcacaggaaccaggagcagtttgttgcctgcctgccttcccttctctccttgtgaattgcctgggtgccccaccgtgggcacaagaatggaagtcgtggcccagagcttccctcgcgaaaaatgagcaaggcgggtgccgggagggggcctttacaggaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcatt

SEQ ID NO: 414147 - DNA, 343 bp, Homo sapiens
tataatttttcaatgtttttatcaccaaagatatatcattttgcaatatgggctgttcccggcaaaatccttttctttagcttcaaaatttgaaaatggtcaaagaaagaccgaaagatcttcagatcaactccttctttcattcatacattcaaaccacaggatgttgccacacagacgtgtaaaattgtttaactagtgactgtcactcttttcttcccaaacaggctcaaagtcagaaaatgagatacaagacatccttggtgatgaggaaacgattacggctttaccgaaacactcttaaagagtcaagtaagttaaaatcctcctttgaatattggtt

SEQ ID NO: 414148 - DNA, 2473 bp, Homo sapiens
gtttgggggagaggtgtgtgagggggtggcggttggagcagggaagtgtgagagagagagagagaccgaccgcgtgcggcaggacctgtcatcactgacgtcggacccggccgcgggcctatgggctacccaggcgattgttcctctctgtgggtccaggccacggccctgaatctctattgacttcctaacgcgccctgctgctacttctgtagtgcgcaggatttcgcgtgggcattaatagccaagggggtgggcgcgcccaaatccaaaccttgggaagaagaagagaaagaaagaaagaaaaaaaaaaaaactttacagaagtttttttgtgtggttttcctttcccctccccactgtcaggtggcagtggtgttagcggcccggtacagggagctccggggagcgtgggtcggcaagcagccggccgccctcccctagccaagcggggcactgaaaatatatatggctggggcgcttcagaaccaccaccacctccaacatcatcatttctgtcacctccactccccgcagggcatcgtgccccggagagccccggggtgttagccgccaaagtgcgcttggggctcagctcctacccctctggagcagaacccccagcaacccacagactcagccctgcgccttccattaccccttacatctactctgccgctaccatccctctctagctcaaggcgcggcgggggacttggcccaacagcaattcggcccaatggcggcggaggtgtttggccttgctctgtccaccgggttcactgctggcgctgtctggctctgagttccacggctgactgcagaggccgtagtgcggcagggctgggcctgccccccggggcccagggaagagcgcgcagcccacgccacccgttctcatgcgcgctatttgtttcgacaacaggtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggtcagtattcggcgctgtctgtcgcgtgcggaccctctggggaagcaggccctcgggtctggatttcctcaagtcccaactgaggggagggggaaatattttggggttgtttccatgagccaaggccataaaatattaattatgcgcttctattcttagaatcacagaagtttccggaggctgtgtgtagggaggatagtgcgggatttctgttctgggggggacaagggtgaacgtgcctaagaccctgtgtgtgcaaacatgtgctctctgcttaagagtttgattttaagatattttaaaacagcattgttccccaaagtcgtaaagacataagaacagctgtctaacttttttccttgtccctttggaattgcgcagcaaaactcttccacctgtagtcctgataacctggcccacctggactgagaggttaccaggccctggagccttctttaggagttgggggtcgaatgggctaactttgtacgtatttttgagccttggggccggacactagggatgtttggtggaccctcactttcgctttagcacagacctatccaccttaaatatcatttaccaagctgctaagggaaatggggacatgtgtcaactacatctgctacttctagttaacagaaaaaaaggagtatcgttcaagagcctgcaaaattgaactcctctggccagagcatctctaattaatacaactgcaaggagaaagttttcacacttccagaacagcctgtgaagttacattaattagtttagcagccattgtttgtactctccttagttagggttttctcgctcctcctccctggaagtttaagaaatcaacatcttctcccctcccccattttgggggcgggagaaggggactggtggggacaggagaaaataaaatgaattccagcttggtgcccc

SEQ ID NO: 414149 - DNA, 810 bp, Homo sapiens
tgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactaggtaagtctccctgtgcggggctggggaggggatcctggcaggatggaggcttgtgagggtcttcagtcatgatccggatctcagaatccagtgtacaaaatacaaatccagtgaatccacattgcatcccgtttgctgttcctgacaccccccccaaccctacagtctcattctgtctccatttagtctttgctcaaatgccacctctttggagacaacgtccctagccattttagctgacaccgccctctgtcactctctccttaccctgctgtagtttccttgcgataagattttcccatctgacacatttgtgtgcgctactgtatttaatgtttgtctacccattagaatgtaaactctg

SEQ ID NO: 414150 - DNA, 1348 bp, Homo sapiens
tgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaccgta

SEQ ID NO: 414151 - DNA, 1181 bp, Homo sapiens
  misc_feature (1181)..(1181): n is a, c, g, or t
cagtcacattctagaagaccatgtgggatgggagatactgttgtggtcacctctggaaaatacattctgctactcttaaaaactagtgacgctcatacaaatcaacagaaagagcttctgaaggaagactttaaagctgcttctgccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccagtaagtgggccagggtcttctgttgagaactctgtgggtttcgctcttccttttggagacagttatcactatgacccacataccacatn

SEQ ID NO: 414152 - DNA, 386 bp, Homo sapiens
caggtggaggctgcatggatttttctgatctagctcaagagttcacacagcatcacttctgctgcattgtattggttacaccaagttacaggccagcccacattcaagggaggtgagttagactccacctcttggtggcagagtggcacagtcacattctagaagaccatgtgggatgggagatactgttgtggtcacctctggaaaatacattctgctactcttaaaaactagtgacgctcatacaaatcaacagaaagagcttctgaaggaagactttaaagctgcttctgtgagtgaaatatgctacatgcctttgtaccaggatctgattggctgtctttcccctactcagatcttcctgtccttgtttcttctgtctttgt

SEQ ID NO: 414153 - DNA, 463 bp, Homo sapiens
acaaagttaaaccctcagcacttgcccacttaccctacgatgtttctaacagattttgccctatcacgctcgtttctctaatgccacagacatcactctcaaatatcctccatgttggtgtgagggatgtgctttctgaaaatcaatgcacatttatcaagaaaaacaaactccaatttctttcttatcttgtacacctgcattgccctgtcctcttgtacagtgagagactgttcagctcctgatgtgactctgttcttcccacagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacaca

SEQ ID NO: 414154 - DNA, 1439 bp, Homo sapiens
cagtcacattctagaagaccatgtgggatgggagatactgttgtggtcacctctggaaaatacattctgctactcttaaaaactagtgacgctcatacaaatcaacagaaagagcttctgaaggaagactttaaagctgcttctgccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaccgta

SEQ ID NO: 414155 - DNA, 348 bp, Homo sapiens
gtgggttgaccgtggcttgtgggttgaccgtggcttgtgggttgaccgtggcttgtgggttgaccgtggcttgtgggttgaccgatggcttcacttacatggctggtgcctttgcagggttcctgggaggctgagcatagctaggattgtcaaccaatgccctacatgtggcctccctagcaaggtggtctcagggcagttggactgtcttcgtggtggctgactttccaaggaagccaggcagaagcaagcaccccttggaaaccaggtggaggctgcatggatttttctgatctagctcaagagttcacacagcatcacttctgctgcattgtattggttacacca

SEQ ID NO: 414156 - DNA, 1292 bp, Homo sapiens
tgctggaggtgaaagtctggcctggcagccttccccaggtgagcagcaacaaggccacgtgctgctgggtctcagtcctccacttcccgtgtcctctggaagttgtcaggagcaatgttgcgcttgggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaccgta

SEQ ID NO: 414157 - DNA, 1039 bp, Homo sapiens
gcaggaaactcagcattatgtgacatactgatcctatcctgatatgttggaagatgaattacacagaaatattaagaaatattcttgtaaaaaaaattaaaagttgtacctgaatctaatcatgcctttagagctaattgatagtttacaagaaacataggtgatggtggagtaaattaaattaaaccatttactatggtttaattaaactatgtaaaaaaaccacatacctttaaaatgtagaacattatagaaacaatctgactcagtttcttaattaaggcaattatagccaaagaaggtggatgggaaaagagggttataattttaaaaacttgatacataacaaccaatggcaatgtgcagatatcgtttatgtcctgattcaaacaaagcagcagaaaaaaaatggcactttggagaaaatcagagaaattttaaaatagtctgattgttagattatatgaaggaattatccttactttctttaggtgtgcaaatggccaagtgattatgtaaataaaagcccacgtacttcaaaattacatactgaagtttataatacgatgtctgaaactcgttttaaaatacattatttcaaacgaagtaataaaatacatgatataacagtgcccaaattttaatatttatctaacatgggaagatggatgctatgggctgaattgtgtcccctccccaaattcagatatgttgaagctctaagcctcaaggtgtctgtattcagagacaggacttttagaaggcagttaagattgtatgaggtcgtaagagtagggtccttatctgaaactattgctggccttataagaagaggaagaaacagagagaaaactccttctctccatgtgcatgtaatgagcaaaggctatgtgaggacacaggaagaagatgcccgtctgcaagccaggaggagagccctcatcagatatggaatcagctttcgtcttgatcttggatttcccagcctccagaactgtgagaaataaatttctgttgtttaagctaaccaagcctatgg

SEQ ID NO: 414158 - DNA, 341 bp, Homo sapiens
cttttgtactatttcaataatctccttggatatactgattgagaaactgttataaggcttactgcgaaattgacgaagtccaaatttgatgactgtcccaaatagttttgtgcctttgatagattttacatgtgtttttttctataaatctgcctttaaaaatttattgttgtcttcagatgttttcatgatatgttcacttagtagtttatgccacatgtctttaatgcagttctagaaacccattgctgagaaagtgaagttctctttcaatatccataatgaaagtcagtttactggcgagcacacctgggtttggcttcctagttattcctccagta

SEQ ID NO: 414159 - DNA, 1142 bp, Homo sapiens
  misc_feature (205)..(205): n is a, c, g, or t
  misc_feature (1090)..(1090): n is a, c, g, or t
gagaacctggagcctaaaccttaggctcacccatttcaaccagtctagcagcatctgcaacatctacaatggccttgacctttgctttactggtggccctcctggtgctcagctgcaagtcaagctgctctgtgggctgtgatctgcctcaaacccacagcctgggtagcaggaggaccttgatgctcctggcacagatgagganaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgaaaactggttcaacatggaaatgattttcattgattcgtatgccagctcacctttttatgatctgccatttcaaagactcatgtttctgctatgaccatgacacgatttaaatcttttcaaatgtttttaggagtattaatcaacattgtattcagctcttaaggcactagtcccttacagaggaccatgctgactgatccattatctatttaaatatttttaaaatattatttatttaactatttataaaacaacttatttttgttcatattacgtcatgtgcacctttgcacagtggttaatgtaataaaatatgttctttgtatttggtaaatttattttgtgttgttcattgaacttttgctatggaacttttgtacttgtttattctttaaaatgaaattccaagcctaattgtgcaacctgattacagaataactggtacacttcatttntccatcaatattatattcaagatataagtaaaaataaactttctgtaaacca

SEQ ID NO: 414160 - DNA, 618 bp, Homo sapiens
tgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatctaa

SEQ ID NO: 414161 - DNA, 570 bp, Homo sapiens
tgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatctaa

SEQ ID NO: 414162 - DNA, 354 bp, Homo sapiens
ggaggctgaggtgggaggatcacttgagcctgggaggttgaggctgcagtgagctgtgactgcaccactatactacagcctgggagacagagtgagaccctgtctcatatatatatatatatatatatatatatatatatatatatatatatatgtatatatatctctaatatattaatatatatctaataaatgtatcttatatataataaatatatctaatatataatatatatatttccaagagagggagaggctcttaggaaattatcttcttgcatattatgttatattatgctatatttggctatttcctaagagctctatcgtattattttcatttatttgtgagaa

SEQ ID NO: 414163 - DNA, 283 bp, Homo sapiens
tcttagttgattaaaacaaataattgaaataaaaaattatgtttattcttacatgtatgccatgtagcactttaaggagatgagtttatgaaattcatgaatgagaggatgatgtaagtttaaaaatcattattttagttgctttattcttctattttaaattcataaataacacaggtggcctgtattttgaaaagagccctttcctccatttgaactttataaacactgaggcagtaggtgtaaatattatctccattttatattgaaggaaatggggcca

SEQ ID NO: 414164 - DNA, 102 bp, Homo sapiens
ttaactactccctgcagtgccatatatgactggacccctacctccttctttgacttcgtctcctaccatttctcttccatccatgctcacttttagccttgc

SEQ ID NO: 414165 - DNA, 874 bp, Homo sapiens
tgatgcattggaaacaaagtaacttctttattatgtaaacaacttgcaaagctcaaaaggtaacagcacagagccataaatttgataaggcactttaaagatagcaatcaaacatataaaaatgtcaaccacaaaaaaactgtaaaaataataaccataaaaaataggggggaatacatgcattctttctagatagtctttcattttccaaaggaaagccttctataaaaatatagaagtacaaatatatatatatatatatatatttagaagccatcatcaaagttcaaatctctgtaaagagaatgtttttcctcaagttagtaaagtttggattcatacattttctagagaagcaattacaatcttcatgctatatataggaagaaaaatagcttttaattatgtttgtcgactcttttattcaataaacatttagtgactattgtgtgacactgttttaggtgctagggatatagaaataaatcagaaacaatcattagccctagagaactaaacctaatggaactggatctatcactggcaaccttaaaattacctccgtttgtacttaagctgaagctcaacttcaaactctgacatgcttggcatcttgttgaaaataaataacgatctacctagtttgccactggtagcactttggcactattaatattaactatatactgatgaaattaactttcataaagggttatacaaaagtttagaggggcagaaaatattaatgggataaacaagtactggtcagccaacaaaaataggcgtcagccttctgctttcacaaaggccaagaaaaccaagaaaaatttcattctgagtatatacagaactgctgggaagagatcattctata

SEQ ID NO: 414166 - DNA, 1435 bp, Homo sapiens
tattgtgggggaaaggggactggtaaggtatcagtcttcctggtagcattgattttcatttgtttgcccccacactatttttaaaaattcaaataaaagtgcagtttcagactttttaaaaaaatactgttgacctgtcttagttgtacattcagaaaatgtagcctcgggtgtttgtatgtaacactgcatattttttctaatcagattaatatgagttttaatgtttagcatgaactacagctaaggataaaaattttaaagtagctttcatagtctagattcctggtttcatcatgctttatgtagtacattttcgtttgttttgttttgtggagacttgtgtgtatttttgtttgtttgtttgtttattggtaggtagtaactatttggaatgtcacagaatacttaaagccagaaatatgggtcagttgatttggtttacaaaatgaaaaaaaattcccagagactgtattagataattattatatatgacacattagctttcttcaaaagaagatgataaatttatagtttcaaaaaattattctataaaaatttctcttattttaaaatattacctaaaattggctcttgtgttttttttcttctgtctaatgaagcttaaaaattcacatattaatttctttttaacccctttttagaagacacagattttaggtctgattataactagaaaacacatcttagaaaaaattgtcatatatatagtttcgtgggggtttttggttttgttttgtttttaattcagcaaactttgaaacattgtatgccaggcaactaattttggcacataattagagctcaactatgacttgctgaaattttgtagccccaaatctcataacaccaaaggaaatcagtaataaaataccactttatttcaaataagcattgaaaatgagattaagcatttaatttttggaagtgacagtattagaactttaatgtcatgattgtcttaagagtaacaggatagatttttagaatatcacattactattatatgtttatttatctcgtagatcatataaatattactttctggtggggaactgaatgttttttatttttttgcctcggttggttttttgtttttattttttgatctgtattagagatgctttaaaggatcttccttttagaaagacaagttttaaatattgaaattgatattaaatatatatttgaatattattaatatttcttatcaaattataagaagtttactatacctttggttaatcctgccttatttcagtaaagaaaatttgtactggaataacttgtagtggtttctaagaataaatagtaagctctattttgtaatagattttagatttgagttttactatttgaaggttttttaatattgccttttttatcatacacattggtttattattttatttat

SEQ ID NO: 414167 - DNA, 1381 bp, Homo sapiens
tattgtgggggaaaggggactggtaaggtatcagtcttcctggtagcattgattttcatttgtttgcccccacactatttttaaaaattcaaataaaagtgcagtttcagactttttaaaaaaatactgttgacctgtcttagttgtacattcagaaaatgtagcctcgggtgtttgtatgtaacactgcatattttttctaatcagattaatatgagttttaatgtttagcatgaactacagctaaggataaaaattttaaagtagctttcatagtctagattcctggtttcatcatgctttatgtagtacattttcgtttgttttgttttgtggagacttgtgtgtatttttgtttgtttgtttgtttattggtaggtagtaactatttggaatgtcacagaatacttaaagccagaaatatgggtcagttgatttggtttacaaaatgaaaaaaaattcccagagactgtattagataattattatatatgacacattagctttcttcaaaagaagatgataaatttatagtttcaaaaaattattctataaaaatttctcttattttaaaatattacctaaaattggctcttgtgttttttttcttctgtctaatgaagcttaaaaattcacatattaatttctttttaacccctttttagaagacacagattttaggtctgattataactagaaaacacatcttagaattcagcaaactttgaaacattgtatgccaggcaactaattttggcacataattagagctcaactatgacttgctgaaattttgtagccccaaatctcataacaccaaaggaaatcagtaataaaataccactttatttcaaataagcattgaaaatgagattaagcatttaatttttggaagtgacagtattagaactttaatgtcatgattgtcttaagagtaacaggatagatttttagaatatcacattactattatatgtttatttatctcgtagatcatataaatattactttctggtggggaactgaatgttttttatttttttgcctcggttggttttttgtttttattttttgatctgtattagagatgctttaaaggatcttccttttagaaagacaagttttaaatattgaaattgatattaaatatatatttgaatattattaatatttcttatcaaattataagaagtttactatacctttggttaatcctgccttatttcagtaaagaaaatttgtactggaataacttgtagtggtttctaagaataaatagtaagctctattttgtaatagattttagatttgagttttactatttgaaggttttttaatattgccttttttatcatacacattggtttattattttatttat

SEQ ID NO: 414168 - DNA, 549 bp, Homo sapiens
aaataacaaaaaaattagctgggcgtgctggtgggcgctggtagtcccagtgacttgggaggctgaggcaggagaattgaacctgggaggtggaggttgcggtgagctgaaaagtgcgccactgcactccagcctgggcgacagagcgagactccatctcaaaaaataaatgaattaattaaaagtatggctgttgagctaacagatgattttataacatgacccaatgctatcttgatccaacttaagcctaagaatcgttgctccccaccccgttcatcaaaaacatcagcagagactttttgggcatgcaaggaaatgttttttatttcataattattttgagatttattttggtgatgtgtttctgactgactgccatattctttgttctcataatttctctactagtattttcactcccaacccccgtgccattcccacttgatttttatgtctgctggcagtgagaggctaaaatggccaacttaagccaaagctgtaaacaacagttgaagtaagtctttcaataaagactagactatatga

SEQ ID NO: 414169 - DNA, 1746 bp, Homo sapiens
tttttttgctttacattacttggtatgtaaataccttgattaaaaccttgtaaaccaatttcaaggttactataagttgtatagtacaagtgttttttaaaaatcttggggtgtttttaaaaattaagatatattttgcccaagaatttttttaacaagattgctaaaaacatcttatttagacacttcaatgtaccaatttataattggatattcagtttaaatagtacacagagttgtggcttttattttcaattaatttttttccttgtgggcagtgtgcatggtataataagcctgagcagaggcttaagttgtatgtgtgcagagtttgtaaaggaatcaattggaagatgcagaagaccgaggtttgctttcaaggtatttttcaggctgtgtgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaatgtttttggaaaagttaatttatattttatagggagaacactcaataaattatgttaactgtgcccccgagttaaaaattttatgagtatatgtgaaacttgaacaactgaagactttttttaattgataaaaatgcttagtatgcctgttttggtctgccagtaaattaagtagcttattgagataactaacagctaaatatagctgtagtgtttcctgactgtatattctatgatttaataaaattatccagactagttatattgccacagtaaacatgtgactgaagtgtccttcatcttaatctgaaagagggcaaaatttcatgatcagttaatggaagttatttcatattaagtggtttgtttttttttttttttagatggagtcttgctctgtcgccaggctgaggcaggagaattgaacctgggaggtggaggttgcggtgagctgaaaagtgcgccactgcactccagcctgggcgacagagcgagactccatctcaaaaaataaatgaattaattaaaagtatggctgttgagctaacagatgattttataacatgacccaatgctatcttgatccaacttaagcctaagaatcgttgctccccaccccgttcatcaaaaacatcagcagagactttttgggcatgcaaggaaatgttttttatttcataattattttgagatttattttggtgatgtgtttctgactgactgccatattctttgttctcataatttctctactagtattttcactcccaacccccgtgccattcccacttgatttttatgtctgctggcagtgagaggctaaaatggccaacttaagccaaagctgtaaacaacagttgaagtaagtctttcaataaagactagactatatga

SEQ ID NO: 414170 - DNA, 1506 bp, Homo sapiens
tttttttgctttacattacttggtatgtaaataccttgattaaaaccttgtaaaccaatttcaaggttactataagttgtatagtacaagtgttttttaaaaatcttggggtgtttttaaaaattaagatatattttgcccaagaatttttttaacaagattgctaaaaacatcttatttagacacttcaatgtaccaatttataattggatattcagtttaaatagtacacagagttgtggcttttattttcaattaatttttttccttgtgggcagtgtgcatggtataataagcctgagcagaggcttaagttgtatgtgtgcagagtttgtaaaggaatcaattggaagatgcagaagaccgaggtttgctttcaaggtatttttcaggctgtgtgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaatgtttttggaaaagttaatttatattttatagggagaacactcaataaattatgttaactgtgcccccgagttaaaaattttatgagtatatgtgaaacttgaacaactgaagactttttttaattgataaaaatgcttagtatgcctgttttggtctgccagtaaattaagtagcttattgagataactaacagctaaatatagctgtagtgtttcctgactgtatattctatgatttaataaaattatccagaactccatctcaaaaaataaatgaattaattaaaagtatggctgttgagctaacagatgattttataacatgacccaatgctatcttgatccaacttaagcctaagaatcgttgctccccaccccgttcatcaaaaacatcagcagagactttttgggcatgcaaggaaatgttttttatttcataattattttgagatttattttggtgatgtgtttctgactgactgccatattctttgttctcataatttctctactagtattttcactcccaacccccgtgccattcccacttgatttttatgtctgctggcagtgagaggctaaaatggccaacttaagccaaagctgtaaacaacagttgaagtaagtctttcaataaagactagactatatga

SEQ ID NO: 414171 - DNA, 1692 bp, Homo sapiens
tttttttgctttacattacttggtatgtaaataccttgattaaaaccttgtaaaccaatttcaaggttactataagttgtatagtacaagtgttttttaaaaatcttggggtgtttttaaaaattaagatatattttgcccaagaatttttttaacaagattggtttaaatagtacacagagttgtggcttttattttcaattaatttttttccttgtgggcagtgtgcatggtataataagcctgagcagaggcttaagttgtatgtgtgcagagtttgtaaaggaatcaattggaagatgcagaagaccgaggtttgctttcaaggtatttttcaggctgtgtgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaatgtttttggaaaagttaatttatattttatagggagaacactcaataaattatgttaactgtgcccccgagttaaaaattttatgagtatatgtgaaacttgaacaactgaagactttttttaattgataaaaatgcttagtatgcctgttttggtctgccagtaaattaagtagcttattgagataactaacagctaaatatagctgtagtgtttcctgactgtatattctatgatttaataaaattatccagactagttatattgccacagtaaacatgtgactgaagtgtccttcatcttaatctgaaagagggcaaaatttcatgatcagttaatggaagttatttcatattaagtggtttgtttttttttttttttagatggagtcttgctctgtcgccaggctgaggcaggagaattgaacctgggaggtggaggttgcggtgagctgaaaagtgcgccactgcactccagcctgggcgacagagcgagactccatctcaaaaaataaatgaattaattaaaagtatggctgttgagctaacagatgattttataacatgacccaatgctatcttgatccaacttaagcctaagaatcgttgctccccaccccgttcatcaaaaacatcagcagagactttttgggcatgcaaggaaatgttttttatttcataattattttgagatttattttggtgatgtgtttctgactgactgccatattctttgttctcataatttctctactagtattttcactcccaacccccgtgccattcccacttgatttttatgtctgctggcagtgagaggctaaaatggccaacttaagccaaagctgtaaacaacagttgaagtaagtctttcaataaagactagactatatga

SEQ ID NO: 414172 - DNA, 1677 bp, Homo sapiens
acccggcatactggatcttctcatagatttaatacatagtgtttttgatttgcatttctataatgaccagtgatgataagcttttttttcatatgtttgttgaccacataaatgtcttctttatgagaagtgtctgttcatatcctttgcccacttatttgttgaggttgtttttttcttgtacatttgtttaagttccttgtgggcagtgtgcatggtataataagcctgagcagaggcttaagttgtatgtgtgcagagtttgtaaaggaatcaattggaagatgcagaagaccgaggtttgctttcaaggtatttttcaggctgtgtgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaatgtttttggaaaagttaatttatattttatagggagaacactcaataaattatgttaactgtgcccccgagttaaaaattttatgagtatatgtgaaacttgaacaactgaagactttttttaattgataaaaatgcttagtatgcctgttttggtctgccagtaaattaagtagcttattgagataactaacagctaaatatagctgtagtgtttcctgactgtatattctatgatttaataaaattatccagactagttatattgccacagtaaacatgtgactgaagtgtccttcatcttaatctgaaagagggcaaaatttcatgatcagttaatggaagttatttcatattaagtggtttgtttttttttttttttagatggagtcttgctctgtcgccaggctgaggcaggagaattgaacctgggaggtggaggttgcggtgagctgaaaagtgcgccactgcactccagcctgggcgacagagcgagactccatctcaaaaaataaatgaattaattaaaagtatggctgttgagctaacagatgattttataacatgacccaatgctatcttgatccaacttaagcctaagaatcgttgctccccaccccgttcatcaaaaacatcagcagagactttttgggcatgcaaggaaatgttttttatttcataattattttgagatttattttggtgatgtgtttctgactgactgccatattctttgttctcataatttctctactagtattttcactcccaacccccgtgccattcccacttgatttttatgtctgctggcagtgagaggctaaaatggccaacttaagccaaagctgtaaacaacagttgaagtaagtctttcaataaagactagactatatga

SEQ ID NO: 414173 - DNA, 1328 bp, Homo sapiens
tttttttgctttacattacttggtatgtaaataccttgattaaaaccttgtaaaccaatttcaaggttactataagttgtatagtacaagtgttttttaaaaatcttggggtgtttttaaaaattaagatatattttgcccaagaatttttttaacaagattgctaaaaacatcttatttagacacttcaatgtaccaatttataattggatattcagtttaaatagtacacagagttgtggcttttattttcaattaatttttttccttgtgggcagtgtgcatggtataataagcctgagcagaggcttaagttgtatgtgtgcagagtttgtaaaggaatcaattggaagatgcagaagaccgaggtttgctttcaaggtatttttcaggctgtgtgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaatgtttttggaaaagttaatttatattttatagggagaacactcaataaattatgttaactgtgcccccgagttaaaaattttatgagtatatgtgaaacttgaacaactgaagactttttttaattgataaaaatgcttagtatgcctgttttggtctgccagtaaattaagtagcttattgagataactaacagctaaatatagctgtagtgtttcctgactgtatattctatgatttaataaaattatccagactagttatattgccacagtaaacatgtgactgaagtgtccttcatcttaatctgaaagagggcaaaatttcatgatcagttaatggaagttatttcatattaagtggtttgtttttttttttttttagatggagtcttgctctgtcgccaggcggaggttgccctgagccaagattgtgctattgcactccaccctgggaaatagagcaagactccgtctc

SEQ ID NO: 414174 - DNA, 1238 bp, Homo sapiens
cagtcatcttccccaggctcccagcattcctcctctctgcagcctgccacctgtcctgcatgtggttctctgccaagtagggcaaacagtccttgggcaggtgcactctgcaggtctccactggtgtgggactcaggaatacaggcggggtcaaagctccccacagccagggcccatctgaatataccagcaagacacagactccatgatcagggccttaaacacagaggaagagtcacattatcactgccccgctagcctggttgtggtgctgccagagaaacaaagcaggacatgagttctgtttgtagagcaaggacttaagatcaaggaggattttgcaaagcaaaaagagtgggatagaactttctgggtaaaatgaacagccttagcatggaaattatttcccagtactcattttcagtttgtggacaatcattcaatcctagacagttctactgtccttccttcctgaggtttaaagtaactaaaccctacacttttctgacaagattttagaatatctttcaattcataattactctttggtgcagagaagtaatgttttcctaaactctcttcagtttactcaaaaacataataaattaattgaggacttaatgtgccacgttggtgcttatcttgaaaatattgctgaaaatcagaaattcacattgccagtagggtctgggattttttctttttgtttttgtttaagtgatttaagaagtttatttcctcatagtaactttcttcccaagtgtgccagtgtttcattaattgttccttcctaggaggaagaaatagaatttctctacaatgagaacacggttagagaaagccccaacattacagaccggtggatcctgtccttcatgcagtctctcattggcttctttgagactgaaatggcaggtgagtctctcttggtctgtcctcccaggaataaggactattctctttgtaactgcccttttgatatttaatagtggaaatattgagagatacagaaaattaaataattgtttccttttacctctcatatagttttgttaaggcttgttaattgtcgtgatatctttgtttcaagaccctggggacttctggcctggtgtggtggctcacgcctgtaatccccagcattttgggagaccaaggcaggcaggtcaccttaggtcaggagttcgagaccagcctggccaacatggcgaaaccctgtctctactaaaaatatattt

SEQ ID NO: 414175 - DNA, 589 bp, Homo sapiens
  misc_feature (30)..(30): n is a, c, g, or t
gattgggccccccccagaggggaggggggnggcttagggaaaccaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagat

SEQ ID NO: 414176 - DNA, 822 bp, Homo sapiens
  misc_feature (770)..(770): n is a, c, g, or t
  misc_feature (772)..(772): n is a, c, g, or t
  misc_feature (811)..(811): n is a, c, g, or t
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatattacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaggaagaaatagaatttctctacaatgagaacacngntagagaaagccccaacattacagacccggtggatcctgncctttatgcag

SEQ ID NO: 414177 - DNA, 983 bp, Homo sapiens
acagtgtaatacaatggaaagaagttgggcattgttgatgctgtcaaattgcacagctccgtgtaaatggcacttcctacagttgtgtagtgggcagtcttggactttgatccacacatactggagtttttggcttttctcactgaccaatgggaattcgcatgtggctcacatggtgatttttttgtgtgcacccctaaacactctgactgccatgtagcacatcctcaacaaacagtcattatgtgattgattcattttggttcttttctccttagtaagtggaggcacttggatggaaggagctgccccttctttgttgtatccaaccctctccccaccccagatgcctggtaacccacttgctgcctgattgacttgtcttacttttagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaatgatgacagaaacagagaggtgcgtatctccaaagcagcggatgacgtggagcaggtccgagacggaaaattatcccataaggtatcctggaaagaaactgggtatcatcagaatcaaagcctaggaaattaggcggcaagtcaccgggggaccacgcaaaggccgcccggaaactcagtggtgaggagggcaacgatcaggccggggagtgagggacagggggagccaaaagagggagaggcccaaggcagtggggagaagaaccccagcgcggggaacaagcccacgag

SEQ ID NO: 414178 - DNA, 856 bp, Homo sapiens
acagtgtaatacaatggaaagaagttgggcattgttgatgctgtcaaattgcacagctccgtgtaaatggcacttcctacagttgtgtagtgggcagtcttggactttgatccacacatactggagtttttggcttttctcactgaccaatgggaattcgcatgtggctcacatggtgatttttttgtgtgcacccctaaacactctgactgccatgtagcacatcctcaacaaacagtcattatgtgattgattcattttggttcttttctccttagtaagtggaggcacttggatggaaggagctgccccttctttgttgtatccaaccctctccccaccccagatgcctggtaacccacttgctgcctgattgacttgtcttacttttagcttataggctttatactgtggtgcctcgcctggtcaagtttgtagatattctgaccaattggtatgttagaatgaaccgcagaagattaaaggtaagtgcagactgctgttgggaaaagcaaaaagtgtatgaagtttgaaagtagaagaaatatgagaatagccagaagggagaggaacattttcagttgctctccgtttttgaagctttgtttttcttttccttttacattgcattttaactatatttgtcatttgagggatagggatctataagttctaaaagtcattttgcattattttcacaacacaattatgtacatgtcatattggagggagaatgtcaaggcacaaacaggactacactgagcagacctcttaaaattcaaaataaaatcatgcaaatattttataaaaatactggtagatatggcattaatattgagaggggtacttccttcta

SEQ ID NO: 414179 - DNA, 4878 bp, Homo sapiens
agcgcgttgcatcacctccgtgcgcccggttgcagcgtggacgccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414180 - DNA, 4721 bp, Homo sapiens
agcgcgttgcatcacctccgtgcgcccggttgcagcgtggacgccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgagcaacaaaatgcttcaacaagttccagaaaacataaattttcctgctgaagaagagaaaatcttggagttttggactgaatttaattgttttcaggaatgcttaaagcaatcaaaacataaaccaaagaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414181 - DNA, 3373 bp, Homo sapiens
cagtcatcttccccaggctcccagcattcctcctctctgcagcctgccacctgtcctgcatgtggttctctgccaagtagggcaaacagtccttgggcaggtgcactctgcaggtctccactggtgtgggactcaggaatacaggcggggtcaaagctccccacagccagggcccatctgaatataccagcaagacacagactccatgatcagggccttaaacacagaggaagagtcacattatcactgccccgctagcctggttgtggtgctgccagagaaacaaagcaggacatgagttctgtttgtagagcaaggacttaagatcaaggaggattttgcaaagcaaaaagagtgggatagaactttctgggtaaaatgaacagccttagcatggaaattatttcccagtactcattttcagtttgtggacaatcattcaatcctagacagttctactgtccttccttcctgaggtttaaagtaactaaaccctacacttttctgacaagattttagaatatctttcaattcataattactctttggtgcagagaagtaatgttttcctaaactctcttcagtttactcaaaaacataataaattaattgaggacttaatgtgccacgttggtgcttatcttgaaaatattgctgaaaatcagaaattcacattgccagtagggtctgggattttttctttttgtttttgtttaagtgatttaagaagtttatttcctcatagtaactttcttcccaagtgtgccagtgtttcattaattgttccttcctaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414182 - DNA, 2362 bp, Homo sapiens
gttgtttctcagtataaatgagatcagttgttgatgactgcatataactgacatgatgtcctgtgtcttcatacgctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414183 - DNA, 4364 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagat

SEQ ID NO: 414184 - DNA, 4761 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagataaaaaaaaatacaaaaaaacaaaaaacaaaaaaaaaaaaacaaatctaaaacaaaaaaaaacataaagacaacaaaaaaaagaggggggggggggcaaaaaaatcccccaggggggggcacccaaagtattgataaataccccccctatttttgatgaccggaggagcactcctaataggtagctctaaatatccgagagccaagcggcgcattaacaacagcatcctgacaggaaaaaacagcttcgggcttccttgagaaaaaacacccttgatgggcgaatggatcattaggagcaccctcccatcaagaatgaaacgccggggaataaataatcagtaggcgtttagtgtttcacccgttgttgtcggggaaagtgtcacgctttttgatatt

SEQ ID NO: 414185 - DNA, 1834 bp, Homo sapiens
ctgattaacagtgtagctgcttctccatagggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414186 - DNA, 1883 bp, Homo sapiens
ctgattaacagtgtagctgcttctccatagggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggcgagatgcagtggatcattcctgaaatctaccacttttggaagccaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414187 - DNA, 3718 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaaccctaccaggtttcctggaatgccaaagtcccccaagtggtttcaattggtggaccgtgggccacctttttctctgcattg

SEQ ID NO: 414188 - DNA, 1398 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414189 - DNA, 956 bp, Homo sapiens
tacaacgaaaaattaatccatagatagaattatgaaagaaatgtgaatttcgaagatatacaggaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414190 - DNA, 956 bp, Homo sapiens
  misc_feature (11)..(11): n is a, c, g, or t
  misc_feature (22)..(22): n is a, c, g, or t
  misc_feature (27)..(27): n is a, c, g, or t
  misc_feature (67)..(67): n is a, c, g, or t
aaaaaaaaaanaaaaaaaaaanaaganaaaaagaagttaaatgaatggtcctcctgcattacatagnaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414191 - DNA, 2573 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcaggtgagtctctcttggtctgtcctcccaggaataaggactattctctttgtaactgcccttttgatatttaatagtggaaatattgagagatacagaaaattaaataattgtttccttttacctctcatatagttttgttaaggcttgttaattgtcgtgatatctttgtttcaagaccctggggacttctggcctggtgtggtggctcacgcctgtaatccccagcattttgggagaccaaggcaggcaggtcaccttaggtcaggagttcgagaccagcctggccaacatggcgaaaccctgtctctactaaaaatatattt

SEQ ID NO: 414192 - DNA, 2835 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggtatgggctgtagggggctgcacatgtacctgccgtgtctccacagcgctcccttcaccaagctgtgaggtggagctctgtgtgagactttagggctgctgttctctgctgcctgatgctggggtaacttagagccatggggaggccatacatgcaggtgcggaaggtatctagggtccgggctatgccaagaccatgggccctagcctgcaaaagagttatgtcatatagttgtttagtcgccagttgttgtttttgtttttgaggtggagtctcagtcttgtcacccagactggattgcaatagcacgatctcggctcactgtaacctctgcctcctgggttgaggcactgcctcagcctccccagtagctgggattacaggcacccaccaccatgcctggctaattgttttatatttttagtggagacttggtttcatcatgttggtcaggctgatcttgaactccagacctcaggtgatccgcccttcttggcctcccaaaagtgctgggattacaggcatgagccacggcacccagcttcgtcagccagttcttggtaccaggaacaccatgttgagtgagacacccctccccttatggaaccaatggagtgggaattgggagatacagtaaagagtcagcaacttttagagagagcacccagtgaaggcggagtcacaggcaagctagggctggccactt

SEQ ID NO: 414193 - DNA, 2628 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggtatgggctgtagggggctgcacatgtacctgccgtgtctccacagcgctcccttcaccaagctgtgaggtggagctctgtgtgagactttagggctgctgttctctgctgcctgatgctggggtaacttagagccatggggaggccatacatgcaggtgcggaaggtatctagggtccgggctatgccaagaccatgggccctagcctgcaaaagagttatgtcatatagttgtttagtcgccagttgttgtttttgtttttgaggtggagtctcagtcttgtcacccagactggattgcaatagcacgatctcgccactgcactccagcttgggcaatagcaagactccatctcaaaataaaataaaataaaacttagagcaaagtttaaaactgagtattcatattaagtgttttattttccatattagagatgggaagggaaccttatgtgtattttattttgttttcaaccatcaataaagttttatctagaaa

SEQ ID NO: 414194 - DNA, 1171 bp, Homo sapiens
catgattgctgtctttctcaactgatataccatgtgacccaaagtccccatcctaaatcatatacttggtctttctgtcctggccagcactaccctgaattgtctcattagcaacaactgtcaggtttggtgaacatacccaccatgagaaacaaagattcctaccaggaaattccaaggatttagaggttcacctcaggagctgggacaaaaggcagaactcttaggataaggccaaattccttactacacaagcagttaacatttttttaaatattcacccccaataggtaaaatactgattttttttcaactttttctttccattctagaaaaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414195 - DNA, 887 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaaggtatgttgggtttttttcagtagaatgaacagcaaatgtagttactaaatgggcattgaaatggtttatggtcccttgtgctttttttattaatttattttttgtagaaaaagtgttagcttccaccttcaaccctattacttaaacggttagcttaaactgaaccatctctcttctgacttctgtgtgcttaattggtctaactttcttgcatgatcaccaatagggaaaaattctaataagtataacatgatatataggccttttctttttttctcaaatacttttttcaatttttttaacttttcattttgaaataatttgacttattaaacaattgaaaaagtagtatgatgggttcccctatatccttcatcc

SEQ ID NO: 414196 - DNA, 201 bp, Homo sapiens
aagagaattggaataattatttaatcatgtttaatagataactttttcttcttgtcatcaaaatgaattcactaggcgagatgcagtggatcattcctgaaatctaccacttttggaagccaaggtgagaggattgcttgaggccaagagttcaagactaaccttgccaacataataagatcctgcctcaattaaaaaaaa

SEQ ID NO: 414197 - DNA, 212 bp, Homo sapiens
caaaaaaacttatggatgtttttaagagaattggaataattatttaatcatgtttaatagataactttttcttcttgtcatcaaaatgaattcactaggcgagatgcagtggatcattcctgaaatctaccacttttggaagccaaggtgagaggattgcttgaggccaagagttcaagactaaccttgccaacataataagatcctgcctc

SEQ ID NO: 414198 - DNA, 2389 bp, Homo sapiens
ccaagttcaattcttaagacattcctgtcttatttcttctaaaatttcacctttaaaatgatgttttcaaagtatggttgaatgtttaatgtgctcaaacactttttctgcaactagggatgaaataatataatttctttctttaaactctgaatgtgatgaatcatattaattcatgtgattagtattttagtataaaccatctcaggcatataaaatagtataaaagaataccttgtacccactacttagcttaagtgaacatccatgtaccctgtacttaagaaatagaacattacagacctgtctgaagacctcacccctgcatagtcttccctgaatgaattccccattaccattatcctaaattttgttttaacttttctcatttttttcttacaatatacattgatgcattctctagtgatagattactttgaattcccaaaataaacccaactagttcatgatagtacatgtcatattaataatcttcctatcataatgcaaaattcctaaaagaaaaaaattagcaggcttgatccagctttcatcctttctggaatatttggtagtactcaaaacttgaaagaaaaacaccataggatctggtctgtccttccttcctttcttcctcttagtagctttactttctttttatttgatctagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagat

SEQ ID NO: 414199 - DNA, 4708 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414200 - DNA, 3391 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414201 - DNA, 2851 bp, Homo sapiens
acagtgtaatacaatggaaagaagttgggcattgttgatgctgtcaaattgcacagctccgtgtaaatggcacttcctacagttgtgtagtgggcagtcttggactttgatccacacatactggagtttttggcttttctcactgaccaatgggaattcgcatgtggctcacatggtgatttttttgtgtgcacccctaaacactctgactgccatgtagcacatcctcaacaaacagtcattatgtgattgattcattttggttcttttctccttagtaagtggaggcacttggatggaaggagctgccccttctttgttgtatccaaccctctccccaccccagatgcctggtaacccacttgctgcctgattgacttgtcttacttttagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414202 - DNA, 4645 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414203 - DNA, 1749 bp, Homo sapiens
agcgcgttgcatcacctccgtgcgcccggttgcagcgtggacgccggatgagttgcttttaggcttgctggcccgcggggctgtccaggcacgcgaggcccctcaggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414204 - DNA, 1568 bp, Homo sapiens
agcgcgttgcatcacctccgtgcgcccggttgcagcgtggacgccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaaaaagaaaaaaaatgggcctcgtggcctaagggtggagctctggggccgttcccttagggagggtaattatggagcctgctactagactcctgcgctgggcgttcgcgtggggaagcggatcaatttcctaaagggggatacggtatcccgaatcgggggaatcccggaaaacatggaggcaagggcccaaagggcgaacggtaagg

SEQ ID NO: 414205 - DNA, 2340 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagacttcctcgttctgccatcttcctaacaaggctatggctgataacgcgtgtggtgtggcgggaattaccggcttgggggtcccggtccgg

SEQ ID NO: 414206 - DNA, 2387 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgctggcaaaaagtgagctggagattggatcacagccgaagagtaaaggtgctgcaatgatgttagctgtggccactgtggatttttcgcaagaacattaataaactaaaaacttc

SEQ ID NO: 414207 - DNA, 2274 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagcattatactctgattaactcccctgtggctgagcagcacgcaaaacctccgcctttcacccgcacgcagcgcgctgtgcgcgcgacgctcctttacgcgcactgctcctgcctcccactggctaccaactgccctactcgccttcctctacctccagaaccgcttcctgaggcctcccgcaccggacgcgcacgacacctagcactcttctctacactgagcacccccggctctcccgacagccccatccctccccgacgcgtggcccctgtccttcctgccgcccctca

SEQ ID NO: 414208 - DNA, 437 bp, Homo sapiens
ttttttttttgagacagtctcgctgtgtcaccaggctggagtgtagtgctgtgatcttggctcactgcatcctccgcctcctgagttcaagtgattctcctacctcagcctcccaagtagctgggactacaggcacctgccaccacacccagctaattttttgtttttagtagagacggggtttcaccatgttggccaggatggtctccatctcttgacctcataatccgcccgcctcggcctcccaaagtgctgggattacaggtgtgagccactgcaccaggcctgtaatttatatattgttttagtttgttgctagtgcttttggtttcatatctaagaatccattgtcaatccagagtcatgttgccccagcaccatgttgaaaactgctcttcctccattgagtggacttggcacccttctaaaaatcattt

SEQ ID NO: 414209 - DNA, 3175 bp, Homo sapiens
gagctcacagcctcctgccagcgcgctctctgtttctctgcagccccgaagctcgcgaatgtagcaggcgccccaagctcggtcctcaagaagccatggcggaatccagggccgtctgtacctttggatgtgcttggctgctgcgctggcatctttcctgatgggatttatggtgggctggtttattaagcctctcaaagaaacaaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacgctacttgggaggaattgctccaccagataagagttggaagggagcccttaatgtgagttatagtatcggacctggctttacagggagtgattctttcaggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggagaatgtcaaaatactccaggagagaagcattgcttatatcaactcggattcatctatagaaggcaattatactctcagagttgactgtactccccttctttaccaattagtgtataaactgacaaaagagatccccagccctgatgatgggtttgagagtaaatcactgtatgaaagctggttggaaaaagacccttcacctgaaaataaaaatttgcctagaatcaataagctgggatctggaagtgactttgaagcttattttcagagacttggaattgcttcaggcagagcccgttacactaagaataagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattaacagaccatggagtatcatttgactccttattttctgctgtgaaaaacttctcagaggctgcttcagattttcataaacgacttatacaagttgatcttaacaatcccattgcagtgagaatgatgaatgaccaactgatgctcctggaaagagcattcatcgatcctcttggtttaccaggaaagctgttctataggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgcaaagccttttttttttttgctctttaaaagttaataattatattagcaaagtgttaatctaatgaagtaaaaaactcctgtgtggcagaaagtaaaagaaaattccctaaattatagcaaggaacatgaattctcagacattgtgagtgtgggaatgtaaaatggtaaaatcacttttgaaaacagtttggcagtttcctataaagttaaacatacacttttactttaggactccagaattccacttctagttatttattcaagagaaggaaaaacaatgatcacagcaatacttgtatgcatgttcattgcaacttaaaagcgtaaaaaccccaaatgtccatccacagacgaatggataaactgtggtatccattacacaatagactacttactactcagcaataaaaatgaagtaactttcaataaatgcaatattattggcagacattgttgaaggaaaaaagccagacaaacaactacataaaatatgtttctatttagatgaagtggcaaactaatctgtagtgttaaaaattagattagtgattgcctgggccaagtggcaggttggggaggatggctgcaaagaagtatgaggaaactttctccaatagatgagaattttccgtatcttgatctgagtggcaaattgtaaacttaaaatatatataaaatttattgtatgaaaattaagcctcaataaatgtgattata

SEQ ID NO: 414210 - DNA, 1773 bp, Homo sapiens
  misc_feature (798)..(798): n is a, c, g, or t
  misc_feature (1770)..(1770): n is a, c, g, or t
atttaatataaatataaatagatacatttaaataatatgcttatacttttttctttattacataatgggctgtcttcttcgttttcataattaactggggtatatttttacattttagaataaatatgacattttgaataatagaatattttgaattttaaataaataacaatttagctatgagaaaataatataaaatagacagcttttaaaatttgacttcaaggtgcatgcttaggtgcttagaagtaaattggcataatgtctgtaccttacttgcaaatgcttcaacagtgttaacaattattgaatttaggtggtagagatatgagaatccattatgctattgcacagcttttcataataaaacactattatgaaaatagttttttataataaaacactgtaaaaaacataatttgctgtactaagtaatttattccttttaaaattctaggaaggttagaatgcatgtttataacatcaataaaattacaaggatttacaatgtagttggaactatcagaggatctgtggaacctggtgagtcacataattttttaaaacattttgtttttacaaaaattaaagggtaagtaaagataaattgtagtcaacaattgaagtggggttttttggctgatttgaaactactaaattttgaggaaaactgtacaaatctaaaagaagattttactttatagtgttgtcttctatagaggaaactcaagcaagaggatgtttattttaaaaacataaattacaaatatttataatgtattcaaagttgtaggtttnttgaacgtattattttccagacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggagaatgtcaaaatactccaggagagaagcattgcttatatcaactcggattcatctatagaaggtaaattttatttcaatttgaagtgaaattttcagaaaggaaattttacttcaagtaacttttattattgagtagaataccatctactaagactataaattctagcttattaagcacctcagatatccccttcctttgagatgcctcagtaatacctttatttttcattttgccacagagaaaataattaggattcatatgaattgatatgattcataactaagctattgcttttaatttctttgatatatttactatttgtttatattactacttaaaactctagtattaaccacatattttctcgataaagatattaatggaatttggctaaaacagttcagaagaaaggttttgcagactattctgtgtagaaatatttcctgtatttgttgtaacaaatttgaagtaagtgtactcacttactcactccttttgaactacaaactcctattgaatctagctcaggatcacctgagcccaggagtgtaagccatagagagaccctgactctcaaaaaaaaaaaaagaaaaagaaaaagaaaaaaactgatctggattgtctacgccaacaggacttgatttctgattagcactactatggagacagtatgattcagaaaatgaagagattcgtgtctctaggctttcattgcattgtgattatttctaaataaatgttagancct

SEQ ID NO: 414211 - DNA, 423 bp, Homo sapiens
aaagtttaccaaaataagcaggaaattacatcttaggtacatggcaaaattaccaacacaggtagacatcatgaataaaaaataatttgggctagatttatttcttgccatttgcaaaaatataatttttctataaaacatatacatgtacatatgttattaaaagtagaagttgatgacaaataatatatagttttattttggcataaatgtagttgcttctacccctaatttccagtatttgatttctctttccagatccccagccctgatgatgggtttgagagtaaatcactgtatgaaagctggttggaaaaagacccttcacctgaaaataaaaatttgcctaggtaagttactgatatgcaccttttctactgtaggataagttatgaattcccctctgcctcttgtttctccaag

SEQ ID NO: 414212 - DNA, 1455 bp, Homo sapiens
gagctcacagcctcctgccagcgcgctctctgtttctctgcagccccgaagctcgcgaatgtagcaggcgccccaagctcggtcctcaagaagccatggcggaatccagggccgtctgtacctttggatgtgcttggctgctgcgctggcatctttcctgatgggatttatggtgggctggtttattaagcctctcaaagaaacaaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacggtatagttttcttgttggatatgagattaagatattttgcactagttgtctattttctcattgaaaaccaatatggcattcttatgttaaacacaaagttttataactaaataactcctgaaataggaataacagagtatactatctttttatttcataaaagtagtcattttagtgactaagaaatcaaaataaaatatcgctctgttcgctacaaatgaaattctcaaatacaaagctatgtcctaagataattctgatttgagatttttcaagcaattgaattttcataggtattcattagatatttatattcaacgtctagtataagaatatgacaatgccccccacttactagaggtatgaccttggatcagttgcttaaactttctccagctcagtttctttatttgtaagatgaggctagtaactgtttctccttgatagggttattataagatcatatgagta

SEQ ID NO: 414213 - DNA, 785 bp, Homo sapiens
  misc_feature (782)..(782): n is a, c, g, or t
gtgaattaagtaacaactttgcttcaactacaggagaatgtcaaaatactccaggagagaagcattgcttatatcaactcggattcatctatagaaggtaaattttatttcaatttgaagtgaaattttcagaaaggaaattttacttcaagtaacttttattattgagtagaataccatctactaagactataaattctagcttattaagcacctcagatatccccttcctttgagatgcctcagtaatacctttatttttcattttgccacagagaaaataattaggattcatatgaattgatatgattcataactaagctattgcttttaatttctttgatatatttactatttgtttatattactacttaaaactctagtattaaccacatattttctcgataaagatattaatggaatttggctaaaacagttcagaagaaaggttttgcagactattctgtgtagaaatatttcctgtatttgttgtaacaaatttgaagtaagtgtactcacttactcactccttttgaactacaaactcctattgaatctagctcaggatcacctgagcccaggagtgtaagccatagagagaccctgactctcaaaaaaaaaaaaagaaaaagaaaaagaaaaaaactgatctggattgtctacgccaacaggacttgatttctgattagcactactatggagacagtatgattcagaaaatgaagagattcgtgtctctaggctttcattgcattgtgattatttctaaataaatgttagancct

SEQ ID NO: 414214 - DNA, 3465 bp, Homo sapiens
gagctcacagcctcctgccagcgcgctctctgtttctctgcagccccgaagctcgcgaatgtagcaggcgccccaagctcggtcctcaagaagccatggcggaatccagggccgtctgtacctttggatgtgcttggctgctgcgctggcatctttcctgatgggatttatggtgggctggtttattaagcctctcaaagaaacaaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacgctacttgggaggaattgctccaccagataagagttggaagggagcccttaatgtgagttatagtatcggacctggctttacagggagtgattctttcaggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggagaatgtcaaaatactccaggagagaagcattgcttatatcaactcggattcatctatagaaggcaattatactctcagagttgactgtactccccttctttaccaattagtgtataaactgacaaaagagatccccagccctgatgatgggtttgagagtaaatcactgtatgaaagctggttggaaaaagacccttcacctgaaaataaaaatttgcctagaatcaataagctgggatctggaagtgactttgaagcttattttcagagacttggaattgcttcaggcagagcccgttacactaagaataagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattaacagaccatggagtatcatttgactccttattttctgctgtgaaaaacttctcagaggctgcttcagattttcataaacgacttatacaagttgatcttaacaatcccattgcagtgagaatgatgaatgaccaactgatgctcctggaaagagcattcatcgatcctcttggtttaccaggaaagctgttctataggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgcaaagccttttttttttttgctctttaaaagttaataattatattagcaaagtgttaatctaatgaagtaaaaaactcctgtgtggcagaaagtaaaagaaaattccctaaattatagcaaggaacatgaattctcagacattgtgagtgtgggaatgtaaaatggtaaaatcacttttgaaaacagtttggcagtttcctataaagttaaacatacacttttactttaggactccagaattccacttctagttatttattcaagagaaggaaaaacaatgatcacagcaatacttgtatgcatgttcattgcaacttaaaagcgtaaaaaccccaaatgtccatccacagacgaatggataaactgtggtatccattacacaatagactacttactactcagcaataaaaatgaagtaactttcaataaatgcaatattattggcagacattgttgaaggaaaaaagccagacaaacaactacataaaatatgtttctatttagatgaagtggcaaactaatctgtagtgttaaaaattagattagtgattgcctgggccaagtggcaggttggggaggatggctgcaaagaagtatgaggaaactttctccaatagatgagaattttccgtatcttgatctgagtggcaaattgtaaacttaaaatatatataaaatttattgtatgaaaattaagcctcaataaatgtgattataaaaaacaagtctgcaaggaaaccagaatcatataccttctcttgtgaaatcaccatgaagtgtgaatggtcaggaaaaagccagtaatattcatacatttaataatttcagctctactgaataaacatataagtctgatgggtgatgaaaatagctactacaatcttcatattctaactcctataaagactgtatatcagaatctgcaaacttttatgcagatcccagtgactcaattacatgttcaactatgattaaagcttcaataaacttggttgttcatctacttc

SEQ ID NO: 414215 - DNA, 3378 bp, Homo sapiens
taaatgttcactgagttcactaaagacaacctacagctgtcactgtctgcagggatgaaaaaaaatcgttttatttccaagcaacattagctggtttattaagcctctcaaagaaacaaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacgctacttgggaggaattgctccaccagataagagttggaagggagcccttaatgtgagttatagtatcggacctggctttacagggagtgattctttcaggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggagaatgtcaaaatactccaggagagaagcattgcttatatcaactcggattcatctatagaaggcaattatactctcagagttgactgtactccccttctttaccaattagtgtataaactgacaaaagagatccccagccctgatgatgggtttgagagtaaatcactgtatgaaagctggttggaaaaagacccttcacctgaaaataaaaatttgcctagaatcaataagctgggatctggaagtgactttgaagcttattttcagagacttggaattgcttcaggcagagcccgttacactaagaataagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattaacagaccatggagtatcatttgactccttattttctgctgtgaaaaacttctcagaggctgcttcagattttcataaacgacttatacaagttgatcttaacaatcccattgcagtgagaatgatgaatgaccaactgatgctcctggaaagagcattcatcgatcctcttggtttaccaggaaagctgttctataggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgcaaagccttttttttttttgctctttaaaagttaataattatattagcaaagtgttaatctaatgaagtaaaaaactcctgtgtggcagaaagtaaaagaaaattccctaaattatagcaaggaacatgaattctcagacattgtgagtgtgggaatgtaaaatggtaaaatcacttttgaaaacagtttggcagtttcctataaagttaaacatacacttttactttaggactccagaattccacttctagttatttattcaagagaaggaaaaacaatgatcacagcaatacttgtatgcatgttcattgcaacttaaaagcgtaaaaaccccaaatgtccatccacagacgaatggataaactgtggtatccattacacaatagactacttactactcagcaataaaaatgaagtaactttcaataaatgcaatattattggcagacattgttgaaggaaaaaagccagacaaacaactacataaaatatgtttctatttagatgaagtggcaaactaatctgtagtgttaaaaattagattagtgattgcctgggccaagtggcaggttggggaggatggctgcaaagaagtatgaggaaactttctccaatagatgagaattttccgtatcttgatctgagtggcaaattgtaaacttaaaatatatataaaatttattgtatgaaaattaagcctcaataaatgtgattataaaaaacaagtctgcaaggaaaccagaatcatataccttctcttgtgaaatcaccatgaagtgtgaatggtcaggaaaaagccagtaatattcatacatttaataatttcagctctactgaataaacatataagtctgatgggtgatgaaaatagctactacaatcttcatattctaactcctataaagactgtatatcagaatctgcaaacttttatgcagatcccagtgactcaattacatgttcaactatgattaaagcttcaataaacttggttgttcatctacttc

SEQ ID NO: 414216 - DNA, 1508 bp, Homo sapiens
  misc_feature (1301)..(1301): n is a, c, g, or t
gagctcacagcctcctgccagcgcgctctctgtttctctgcagccccgaagctcgcgaatgtagcaggcgccccaagctcggtcctcaagaagccatggcggaatccagggccgtctgtacctttggatgtgcttggctgctgcgctggcatctttcctgatgggatttatggtgggctggtttattaagcctctcaaagaaacaaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacgctacttgggaggaattgctccaccagataagagttggaagggagcccttaatgtgagttatagtatcggacctggctttacagggagtgattctttcaggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaagctgatgagtaangtcgggactcgaagacttcctttgggcgctgggtgcccacatgtggctcggctccccagaggggggggttgaccgagcggtcttatttggcgcgggcccttttgttcccggccagatcttctctcagggtgtgtcggcaacacctcagtcttcctcccgccggcattcccggcgatcgcgtttgccggtcttcccctttttgtgtcc

SEQ ID NO: 414217 - DNA, 453 bp, Homo sapiens
gtcttactctgttacccaggctggaatgcagtggtgtgatcatagctcattgcaacctctgccctctaggctcaagtgatcctcccacctcagcctcccgagtagctgggactacacgtacatgccaccatgcccagctaatttttgtatttttggtagagacggggttttgccatgttgactaggctggtcttgaactcgtgagctcaagtgatctgcctgcctcggcctcccaaagtgctgggattacaagcgtgagtcatggtgcctggcctagtttgctcttattttttttccatctttgcagtttctaggccactgggaacaggctgcagagctcagagtccacagctgtgaggctccatgttgcaccatcaaaaaataaggtgacgagagtcctggttttccccagtgtcacggcaagaggggttactgctcacgggctacacacag

SEQ ID NO: 414218 - DNA, 3436 bp, Homo sapiens
agacgtttcccgccggcgggagctgtggctgtgattgagagaggggttagaggcgggtcccagcgctgccgcaccatggcggaccagctttatctggaaaatatagacgagttcgtcacggaccaaaacaagatcgtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaatgaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaaca

SEQ ID NO: 414219 - DNA, 648 bp, Homo sapiens
cgtccgaaaaattatgctggggtctcgactaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaacagtgcttcaaactgagtatctgatgagtctcttatttgatggatggtaacagtgttgcaattatttaagctctgaatgggaagaaggctggttttcagttgatattgttaaaactgcatacccacagtctgagatgaacaagttatttgctgccttcatcgtttttttcagcactggggaaatgttagtttcagccaacctcattttttagttcatctagaagaaaatctagcacattgtattagtttggcttcatcacttgctagctgtatgactgtgggcaagtttcacagcctcaagttctttatcaaaataaaactaaaatgagttac

SEQ ID NO: 414220 - DNA, 2608 bp, Homo sapiens
caagagtccttcttggactatttggccgtccttttctaccctctggaattaagaccacgagttataaagcaaaacccataagagcatgtgaatacttacatttttgttctgtgtaacacgcttaatttatttctggatggcaacagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaatgaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaaca

SEQ ID NO: 414221 - DNA, 3767 bp, Homo sapiens
agacgtttcccgccggcgggagctgtggctgtgattgagagaggggttagaggcgggtcccagcgctgccgcaccatggcggaccagctttatctggaaaatatagacgagttcgtcacggaccaaaacaagatcgtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaatgaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaacagtgcttcaaactgagtatctgatgagtctcttatttgatggatggtaacagtgttgcaattatttaagctctgaatgggaagaaggctggttttcagttgatattgttaaaactgcatacccacagtctgagatgaacaagttatttgctgccttcatcgtttttttcagcactggggaaatgttagtttcagccaacctcattttttagttcatctagaagaaaatctagcacattgtattagtttggcttcatcacttgctagctgtatgactgtgggcaagtttcacagcctcaagttctttatcaaaataaaactaaaatgagttac

SEQ ID NO: 414222 - DNA, 317 bp, Homo sapiens
cgtccgaaaaattatgctggggtctcgactaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaaca

SEQ ID NO: 414223 - DNA, 2565 bp, Homo sapiens
catttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaactcgagactagttcctcgtgccgaattcggcactgactgaaaaagtctacgagagtgaatcctgcacagatagtgaagaggagcttaacatgaagacatcctcagtacacagaccccctgccatgactgtgaaaaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaatgaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaaca

SEQ ID NO: 414224 - DNA, 1885 bp, Homo sapiens
  misc_feature (1885)..(1885): n is a, c, g, or t
gtgcgcacgcacacacggtgcacacgtcagtccggcgcctccccgtgccccgactcacgcaggtcctcccgcgcgcccgcaacacgcccgcaggctcctgtgtctgctgccggggcagcggggcccggaaggaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacan

SEQ ID NO: 414225 - DNA, 1593 bp, Homo sapiens
  misc_feature (1593)..(1593): n is a, c, g, or t
cagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacan

SEQ ID NO: 414226 - DNA, 516 bp, Homo sapiens
  misc_feature (516)..(516): n is a, c, g, or t
ggagctccagctataagctggaagtgtctgtgagttgtacacaccatcaagcagcgagcctctcatcaattagggttagggaaccaaggttcgattctcaggaaatcacaatttcattcatttactcaatatgaatttacaaagtgcctacatattatccgcttccacttgcagccatttctagataaaaaagaaacctggcatctcaaaggggccaccaagttctccccgagtctaccactgaaagccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacan

SEQ ID NO: 414227 - DNA, 413 bp, Homo sapiens
  misc_feature (413)..(413): n is a, c, g, or t
actcggctcggtcctttccgggaggatggggtgtctttgttgtggttggaggttggtgatcattgctctggatttggggctcccggctgccaccacatgcagctttgcctcacctttctccagcagccgggaccctctggagagccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacan

SEQ ID NO: 414228 - DNA, 186 bp, Homo sapiens
  misc_feature (186)..(186): n is a, c, g, or t
gaggtttcaatattttattcaagttttttaagtgttgttaattacagcattttagagtcttccattttgttggaattagatcctccccttcaaatgctgtaattaacaacacttaaaaaacttgaataaaatattgaaacctcatccttcttctgttgtctttattaataaaatataaataaacan

SEQ ID NO: 414229 - DNA, 1854 bp, Homo sapiens
  misc_feature (1854)..(1854): n is a, c, g, or t
cagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacan

SEQ ID NO: 414230 - DNA, 2264 bp, Homo sapiens
cagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaaaaaaaaaaaaaaaaaaaaactcgagaaaagtttggtatgtttctctcaagaaaaaagcatggtgagtccagacagcagcaaaagcttttgtgaaaaccaattgtgttcatctagatagtaagtaactcctatttttactgttaattttttaaaagagaatttttccctgtggaaactccctgttagtacgtcctaggggagaaagcctgtggaatatggtggttattgatggcgttgcctttgtttcatctttgagtttgccctttgtgggatctagtgggataatgagcactgacagaactcttaacagcgtgctgtatttttgacattgaaaatgttaatgacttgatttgtacataactctgtaactaggtgaaagtagatcacagctgacatttacaaaatgtttttgtaccttagaatttctgcattaaataaaatgtttgttttaaaaaaa

SEQ ID NO: 414231 - DNA, 1875 bp, Homo sapiens
cagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaagatggcctcgttggctacagcgtggagtgtgcggcagacaacacgtcccatataacccctatatctatg

SEQ ID NO: 414232 - DNA, 1797 bp, Homo sapiens
  misc_feature (1797)..(1797): n is a, c, g, or t
cagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaagtttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacan

SEQ ID NO: 414233 - DNA, 3465 bp, Homo sapiens
  misc_feature (1)..(1): n is a, c, g, or t
naagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgtccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggctccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataaga

SEQ ID NO: 414234 - DNA, 3497 bp, Homo sapiens
  misc_feature (1)..(1): n is a, c, g, or t
naagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgtccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggctccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataagaaaaaaagccacacaaggaagaaggcaagaaca

SEQ ID NO: 414235 - DNA, 3206 bp, Homo sapiens
cgcacttctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgtccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggctccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataaga

SEQ ID NO: 414236 - DNA, 1634 bp, Homo sapiens
cgcacttctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataaga

SEQ ID NO: 414237 - DNA, 1824 bp, Homo sapiens
  misc_feature (1)..(1): n is a, c, g, or t
naagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcctcttttataaggactccaaccctgttcatgagggctccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataaga

SEQ ID NO: 414238 - DNA, 3313 bp, Homo sapiens
  misc_feature (1)..(1): n is a, c, g, or t
naagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgggctccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataaga

SEQ ID NO: 414239 - DNA, 1276 bp, Homo sapiens
cgcacttctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcggtgagtggcagctggggccacgggggatagagtggtcatggggactgaagcagtgaagaacaactcttctaggcatcctaggacttcatctgtcccagctcctttggtgcagcagtcataggagaaagagcctgggggcacagagagagcaagtaacttactaaaggtcacccagcaagttaggagcccagccggggcaagaacaatagtaataataatagtaacaacagcagcaggaggaggacagcagcaggaggagagcagcaggaggagcacagcaggaggaggacagcagcaggaggagcggggat

SEQ ID NO: 414240 - DNA, 282 bp, Homo sapiens
caaggtttcacataggcaggaagcaaggaggatagtgaagcatctaggtggaggtggaactcttactgagaaaaacatgaagtagtaaaatcaccctttctttgatataaatgcatttagaagtcaatgagggcacttacagctgtgtttcccttcactaacttttcatctcttgcattctttacttctctttctcaatttattcatcttgaggtatacttatcctgagttgactctgagcagcccatcctcaaaacacaaacaatgttaggatgagaagtt

SEQ ID NO: 414241 - DNA, 669 bp, Homo sapiens
aaaaaaaaaaaaaaaaaggtacctgtcagaaaaatctagagagcaaaacggtacacatactgaagagtagctctctcttctgttcctctactttttagaagctgtttccttcattctgttcctggcctcaagtgatcctcccgcctccagctaccagagtgctaggattataggtatgagccaccacacctagccaattattctttctaaaacacactctgattatgtcatcctctttttcagctatctgcagagaatcccattgtgtgtagaatgtttttaacttgacagaggtttccatggctctctcaggtcctcgtttccaagaaggaacaactgttgtgtctaaaagggctactgccttatgcagcctatttgctgcatgaactgtgcatgatgtatgcccagggacatttctgaaacaagtaccttgggcacctatgtgcttccaaagctgtatgtgaagctacataactacatgagttgtgccattcgcagaaaggtagtcaagaatcgaacttgtaaagcctgcaaggaccaaacatgtctacctgacttagacttttgagtgctgccccatgacctccaccaaagtccgtataaggagccgactccttaaggactgaagaaaaactatcttctggaaaaagataaagtggagattatact

SEQ ID NO: 414242 - DNA, 942 bp, Homo sapiens
tgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccacattgctgtgaggaagcctgggctacatggagaagcccacatgaagaggcccatgtggagaggaactgaggccctgacacttggccccatctgcactaccagctgatagccagcatgagcctgccagccagagtctgcagaccatacttaaattcccacatctccatgattgaagggaatataaagatgaaactgaagttcacctttttaataggactatatcctccaagatcctagaaagcgttgtgtggccctgattcagatgtctgctttcctatggcaccaaaacaatttttacttggaaaggacactaacatttattgaataaacctcatcccagccaagagcttcttaatctttgtctcattccctcaccaaccttgggagatagactgattgggaactgaagttcaaagaggttgaatggggttacctacctgctaaattctagtcccctcactagtaaatgatgaggttgggccatgaggtctgcctgactccaaagaccttgccctttccaatacttcatgctgcctccataattgagggtggtagaatgcagaacagggagtcatttgtcactgtggtggagaaagagttggtttttgactttgggatttagggatacatatgtcctccttcctccttcccctcctagagcaagagctagaagcgaaagaatagaaggtgatgacaacactgcatatatttcag

SEQ ID NO: 414243 - DNA, 566 bp, Homo sapiens
tgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcgccacattgctgtgaggaagcctgggctacatggagaagcccacatgaagaggcccatgtggagaggaactgaggccctgacacttggccccatctgcactaccagctgatagccagcatgagcctgccagccagaactgtaaaatagcctcaggcaggtccttcaggaggtatggacaagaaggcattgctatcacaggagacgacagctccatgcatgttcctgtccctgaaggccttccagtcagtcaagatgtggaggcggaagacagtgatataaatgatcctgaccctggtaggctaatgtgtgtatttgtgtcttagtttttaagaaaaaagtttaaaaggtaaataaaataaaaaatattaaaaatagaaaaaaagcttacagaa

SEQ ID NO: 414244 - DNA, 1820 bp, Homo sapiens
tgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcgccacattgctgtgaggaagcctgggctacatggagaagcccacatgaagaggcccatgtggagaggaactgaggccctgacacttggccccatctgcactaccagctgatagccagcatgagcctgccagccaggccagcacagtggctcacacctgtaatcccagcatttcgggaggccaaggtggccagatcacttgagtccaggagtttaaggctgcaatgagctacgatcgcgccactgcactccagcctgggtgacagtacgagatacaacagatgaacacacttcctgtttatgtgctttagttcctttgtatgtgcattttagaaaagtcagaagtctttggtactttgcagcatgtgtgcattggtacaacttctaggaagggcaatttggcaccatctatcagatttacttatgtgcaaaatgatatgtacaagtttattccagcctgatttgtaatagcaagaagaaatggaactagcctgaatgtccctcaatagagtactggttaagtaagtcatggtatatacccaaaataaaatgtaatgcaattaaaaataaatttaagaagagcaaggaagctttccatatatgggtgtggaataatgtccaaaattgttaagtgaaaaagcaaaattcatatcatggttgagtatgtgctcatttgtataaaaagagggtaaacagaatattccaggaggatatgcaagaaactgttaacattggttgcctttggcagctgaagggcgaggtgagaggagactttccactgaatccccttttacaccttttgaattttgaaccaggtgggtaaataacttagtcaaaataaaataaaataaaataaaataaaataaaattggtggaacaaaaataaaaaggtgacttgatggaaaagaaaggagaaagaaaaggagtaaaagacatagggagctacatatatacattatgtcatacatacatacatgcatagagagatgtttactgctttaatctgggctgtcaccctgactcaccttacggacttccttttgctccctcctcttttgcctcatagagtctgcagaccatacttaaattcccacatctccatgattgaagggaatataaagatgaaactgaagttcacctttttaataggactatatcctccaagatcctagaaagcgttgtgtggccctgattcagatgtctgctttcctatggcaccaaaacaatttttacttggaaaggacactaacatttattgaataaacctcatcccagccaagagcttcttaatctttgtctcattccctcaccaaccttgggagatagactgattgggaactgaagttcaaagaggttgaatggggttacctacctgctaaattctagtcccctcactagtaaatgatgaggttgggccatgaggtctgcctgactccaaagaccttgccctttccaatacttcatgctgcctccataattgagggtggtagaatgcagaacagggagtcatttgtcactgtggtggagaaagagttggtttttgactttgggatttagggatacatatgtcctccttcctccttcccctcctagagcaagagctagaagcgaaagaatagaaggtgatgacaacactgcatatatttcag

SEQ ID NO: 414245 - DNA, 750 bp, Homo sapiens
tgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccacattgctgtgaggaagcctgggctacatggagaagcccacatgaagaggcccatgtggagaggaactgaggccctgacacttggccccatctgcactaccagctgatagccagcatgagcctgccagccaggtaagaggacatgaattgccttggagttttaccctaaaggttgtggatcaggaaaggtcctaaacaaagcacaggggaatggcactaatctcaccagtaaggtgtgtagccaaaccagctgttccctgttaagaactgtaaaatagcctcaggcaggtccttcaggaggtatggacaagaaggcattgctatcacaggagacgacagctccatgcatgttcctgtccctgaaggccttccagtcagtcaagatgtggaggcggaagacagtgatataaatgatcctgaccctggtaggctaatgtgtgtatttgtgtcttagtttttaagaaaaaagtttaaaaggtaaataaaataaaaaatattaaaaatagaaaaaaagcttacagaa

SEQ ID NO: 414246 - DNA, 4123 bp, Homo sapiens
gagagaagtacacacgcaccccctcactgcctactcctgctttcgggagcctgagtcattcctgccccctcgtagggttccccatttcccggtgcgcgggcaccctgagacagccttgggaattcgttcgcgtccccttccacctgggtccccttccccagtttgcgccccgtaacactcagccaaggacttcctgtgggtcccaggtcaggggccaaggggtcctggaccgctgccacagccccggtgcgcccgggggaggcgcttccttttcctgaactctgggatcctgcgggaggaagtggggaagttgggcgggggtgcagccgagggcgtgccgactgtggaggggccgaccctcgcgcagctctgggccttccttggggaggagctggggtgccagaggcccaggctgaggagcttggcggcgaggtatttggggaagtaaggcctggggtggagaagcgcggaggaatgggccgggcccggctgggaaggcagccctctcccatccacaggtctccctgggttctggcaggagcctgcccctgctgccggcctggcttacttgtccctacttgtcaacaccctggcagcggggtcttcacctggttccagccccttttccccaaggcggcagagaggatggggctgaggagtctgggaaggggccatgggagtccctgctgagctcggggcaggaagtttctgggttgcatcttagccggccccagggagtgcagagccagggagaggggtaccagggacaaaccctagacagacggccctgtccacggttgctcctgctctcctaggaggccccgtgtgggccgcggcccggccctcaccatggagtccatgttcgaggacgacatcagcatcctgacgcaggaggccctggggcctagtgaggtgtggctggacagtcccggagacccctcgcttgggggcgacatgtgctccgcctcccactttgccctcatcactgcttacggagacatcaaggaacggctggggggcctggagagggagaacgccaccctccgacgccgcctcaaagtctacgagatcaagtacccactgatcagtgactttggagaggagcatggcttttctctgtatgaaatcaaggatggctccctgctggaggtggagaaggtcagcctgcagcaacggctcaaccagttccagcatgagttacagaagaacaaggagcaggaagaacagcttggagagatgatccaggcctacgagaaactctgcgtggagaagagtgacttggagacagagctgagggagatgagggccctggtggagacgcacctgcgtcagatctgtggtttggagcagcagctgcggcaacagcaaggcctccaggatgcagccttctccaacctgagcccaccgccagcccccgcccctccctgcactgatttagacctgcactacctggcactgagagggggatctggcttgagtcatgcaggctggccgggctccacacccagtgtgagtgacctggagcggcggcggctagaagaggctttggaggccgcgcagggagaggcccggggggctcagctccgggaggagcagctccaggccgagtgcgagcggctgcagggggagctgaagcagctgcaggagacccgggcccaggatctggcctccaaccagtcggagcgagacatggcgtgggtgaaaagagttggggatgatcaggtgaatttggcgctggcctacaccgagctgacggaggagctgggccggcttcgggagttgagttccctacaggggagaatcttgaggactctgttgcaggaacaggcccggagtggcggccagaggcactcgccgctgtcacaacgccactccccggccccccagtgcccctccccctccccgcctgcccgagcggctcccccgtgccccccgtgccagtcccccgtcccccagcgccgctctcccgtgcccccgtgcccctcgccgcagcagcgccgctctccggcctcaccctcctgcccgtcgcccgtcccgcagcgccgctcgccggtgccgccgtcgtgccagtcccccagcccgcagcgccgttccccggtgccccccagctgcccggccccgcagccccggccaccgccgccgcccccgccgggcgagaggacgctggccgagcgcgcctacgccaagccgcccagccaccacgtgaaggccggcttccagggccgccgcagctactctgagctggcggagggcgcggcctacgcgggcgcctccccgccctggctgcaggccgaagcggccactctccccaagccccgggcctacggcagcgagctctacggccctggcaggcccctcagcccgcggcgcgccttcgagggcatccggctgcgcttcgagaagcagccgtcggaggaggacgagtgggctgtgcccaccagcccgcccagcccggaggtgggcaccatccgctgcgcctccttctgcgcgggcttccccatccccgagtcgcccgccgccaccgcctacgcccacgccgagcacgcgcagtcctggccgtccatcaacttgctgatggagacggtgggctccgacatccgcagctgccccctctgccagctgggtttccctgtcgggtacccggatgatgccctcatcaaacacattgactcccacctggagaacagcaagatctagggcaccagccccacccactggctgtttctccgtcctctcctatcacccccaaacactcactttgaatgctgcatgaatctcgtggggggtccctgcccttgcgacccccagatacctccacttgctaccgagtcaacgtgtgtgccatcttccctggtccaggcaccactcagctctggctcttcctgggaggtcagccgaggctccccccatgctcctggtttctgcttaggaggtggggacttgggctgggatggggacggcatacccctcccaggcctctccctctgcctttctgttcttaatcagggttggatccaagaaggtgtccagtgcttgggcctggggtggggggaaggtgttagaggactccaggagctcctgcacccctccccaaatgtccatctttctcagacggggctctgtctggggagcacccacaggctgcctttggggtcccagagcctgctctgtgcactgaccccagttcctccatcctgtggccagcctagggctcatggcatgggcccccactgggggagggaggcatcttgtttcttgtggttccctgcaggccagtcctgtcctcctttccctgttctgcccactctggggaatagggaggggaggagaggagaggagagggaggatcctggaggactgggaagatctagcctaaagaggcttctctgagggccagggccctacagcatgcccctacggccaggggactgtctgccagcctcccaggcccatgccctcctggtgcccctggcactgaggcacagatcgtcaaggcaggtaccccctcaacccttcttccactggagcccctgacaccacaggtgccctggagcccttgtgtgactcagcctctgttagctgggtgggtgtcatcagcccctgcctcccaggccagaacctgagaacgggcccagggtgctgtggagatcaacttcaaaagagctaaccccttcccacactccacccacccacctacatttcctctgtgaaatctacctcagagttgtaccctcagaaggacgggtaagcaggaggccagggggtccccagggctgaggtggggagccttctacggcgaaagcctgccaccccacaatgaatccaccctgctccactgcgcgcctctcccaggtctcagctctgggtggggagcagtggccgctaccgacagcgcatgtcccgctcttatccaactcttccaggccccacctccctgcacccctcccctctatagagcaggggagtgaaggggtatgtcaggcggggaaggggccaaggacacgtcattgtaccctgagcgtccccagggagtggaaatggggaagggggcctggagaggggaggcaggggcccctgtgctctctgaacaagttgaaagtccaaataaaacttacctgttcca

SEQ ID NO: 414247 - DNA, 395 bp, Homo sapiens
aggggccgcaggaggggcccgggccgacagaggcactcaccccttccccagccgccttccattgcgctcacccgggcgctgggcccagagaggaatgcggaggaaggaggcatttgtggaggccccgtgtgggccgcggcccggccctcaccatggagtccatgttcgaggacgacatcagcatcctgacgcaggaggccctggggcctagtgaggtgtggctggacagtcccggagacccctcgcttgggggcgacatgtgctccgcctcccactttgccctcatcactgcttacggagacatcaaggaacggctggggggcctggagaggggaggcaggggcccctgtgctctctgaacaagttgaaagtccaaataaaacttacctgttcca

SEQ ID NO: 414248 - DNA, 1183 bp, Homo sapiens
ccaccacatgctccaccccaatctgtctggccagtaataagtgctctcgggtctgttcttaatcagggttggatccaagaaggtgtccagtgcttgggcctggggtggggggaaggtgttagaggactccaggagctcctgcacccctccccaaatgtccatctttctcagacggggctctgtctggggagcacccacaggctgcctttggggtcccagagcctgctctgtgcactgaccccagttcctccatcctgtggccagcctagggctcatggcatgggcccccactgggggagggaggcatcttgtttcttgtggttccctgcaggccagtcctgtcctcctttccctgttctgcccactctggggaatagggaggggaggagaggagaggagagggaggatcctggaggactgggaagatctagcctaaagaggcttctctgagggccagggccctacagcatgcccctacggccaggggactgtctgccagcctcccaggcccatgccctcctggtgcccctggcactgaggcacagatcgtcaaggcaggtaccccctcaacccttcttccactggagcccctgacaccacaggtgccctggagcccttgtgtgactcagcctctgttagctgggtgggtgtcatcagcccctgcctcccaggccagaacctgagaacgggcccagggtgctgtggagatcaacttcaaaagagctaaccccttcccacactccacccacccacctacatttcctctgtgaaatctacctcagagttgtaccctcagaaggacgggtaagcaggaggccagggggtccccagggctgaggtggggagccttctacggcgaaagcctgccaccccacaatgaatccaccctgctccactgcgcgcctctcccaggtctcagctctgggtggggagcagtggccgctaccgacagcgcatgtcccgctcttatccaactcttccaggccccacctccctgcacccctcccctctatagagcaggggagtgaaggggtatgtcaggcggggaaggggccaaggacacgtcattgtaccctgagcgtccccagggagtggaaatggggaagggggcctggagaggggaggcaggggcccctgtgctctctgaacaagttgaaagtccaaataaaacttacctgttcca

SEQ ID NO: 414249 - DNA, 356 bp, Homo sapiens
  misc_feature (19)..(19): n is a, c, g, or t
cgcggcccgcgactacggntgctagaagacgacagaagggcaccccacaatgaatccaccctgctccactgcgcgcctctcccaggtctcagctctgggtggggagcagtggccgctaccgacagcgcatgtcccgctcttatccaactcttccaggccccacctccctgcacccctcccctctatagagcaggggagtgaaggggtatgtcaggcggggaaggggccaaggacacgtcattgtaccctgagcgtccccagggagtggaaatggggaagggggcctggagaggggaggcaggggcccctgtgctctctgaacaagttgaaagtccaaataaaacttacctgttcca

SEQ ID NO: 414250 - DNA, 1816 bp, Homo sapiens
tgtgcacaatttaaatttgatgtttttgtttttgccaagctgctttttaagaaggttgtactaatgcacacttttatcttgacactaagattttaaatatgatcagaaaatgggtttctgatagtaaaactgtctacttgtaataattgtggcattagaaaagacctttgtggcttcgttcctcaaactcatttacgaattataaatctgaattccaaatatgaattaactcacacaagataaagctttaacagttagtagcagtactgtaactagagtgcatgttttctgtctccagaaataacattctttttatgccacatttttttaactgaggtgatcattctccaccctcttctttccatgtttttccatgtttgttcaaacttttcattaaatatcttgaggctctaactaaattaagggtggccattaaaattgtatgtgggattccctgaaccaactggtaatgcactaccagcatataaggtgtcctcattaaagcagttggtgattggtacatgggacctcactcatgtatgtttgcatctacttgtgagtcaaaaagttttcttaaagtataggtgggatcatgaaagacatacaattcactggagaaattgtgaaaaagtaaaagattatgaatttaggctcaaagccaatttccctctcatttaattctacatgagcaagtcaaggagtttggtagagctttatgaaatctctaaagattgaaggaaaacaatcactaaaatcgatttgataaagtgcaactaagtagtatgctagcctgttaatggattttcatcttgtcatttaagtttcagcaattgagtaccacactagaacacccacaaatgagattctgttacagagtatcttttttctactacagaacatactgtagacagttattcagtggttaacttgtggaaataatcagaagatgcttttcacttttatgactggatatattttaatatttatcatattaagagaaacttaggttacttacagctcataaacgttgctatgaacatcattcatttattcacttatttatttttatggtgttcctagaaagaatttcctggactaaaggatttatgctttaaaaatattggtagttactgccaagaattgccatccagaaacagtgtagccattcataaactcaacaacaaggtatgagagtgcctgtttcctcatatcctttgtgacaccggattttatcaagcttaaagttttttcattctaggtgggtgaaaatggtattccgttattgataatgtgtggaaatcaagttctaataagtttggggggaggttaattctttatatgtgctgtatgaattaatgccaactgtatgcctttgagagtgaaatcagaataatgtctctccactaaagcaggacttagagcactagttttccaaatgttgtctacagatggaaacactagcatcacctgggtactcgttagaaagtgcagattctctggcggtaccttagacctcctgaattagaaactctgggggtagggttagacatttgtgttttaaacaagccctccaagtggtttcaatgcacattcaaagttgagaaccaatcactgatagagaaaaagcagcttgggtagaaacagttgattatttgcaaatttatattttaaaaagataggattcttaacagtaagctctttataattcaacaatgtgatctttactcctacccccgaaaaactaatatgattttagtgtgtggtagctggatcgaaaacataataaatactcagatatgcaaagaaaaaattttct

SEQ ID NO: 414251 - DNA, 3372 bp, Homo sapiens
  misc_feature (3095)..(3095): n is a, c, g, or t
  misc_feature (3266)..(3266): n is a, c, g, or t
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtntatctactttgctttgttaaaacatcatgagagtggaggcctgccacccagaaaggcacatactagtgccttttagtacaattttatgtcatgtagaagaaaatggcaatgttcctcctattgatacagatacaggcatatgtcatcttattgcgttttgctttattgcantttgcaaataatgcattttttacaaatggaaggtttatggcaactctgcgttgagccagtctattggtgccatgtttccaataaaacttctcctttcaaaaaaaaa

SEQ ID NO: 414252 - DNA, 137 bp, Homo sapiens
ccgatcgtcagaatctgcatttgacagttggtcttggcttggttgctgccagagtcttcggcatcttgatctgtctggttgtgagaaaatcacagatgtggcccaacacggtgcgttggcccaacacagctgcgctg

SEQ ID NO: 414253 - DNA, 2679 bp, Homo sapiens
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagt

SEQ ID NO: 414254 - DNA, 2311 bp, Homo sapiens
gggagatggctcggacatcatagcgatcccggccaccatatcgatccatatcccggcgagggccatcccgatacccatcccgatacccatcccgataccggtctgaatcataacgatctcgatacttgtctccaaagctatcatcacctcttctaggtgggtagtcatcaaagctgtctgtagcaggacgagccctccagtctgtatctgttttgtcagaatcccgatttctatcacggccaaaagaacgatcatccctgtctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagt

SEQ ID NO: 414255 - DNA, 3314 bp, Homo sapiens
  misc_feature (3037)..(3037): n is a, c, g, or t
  misc_feature (3208)..(3208): n is a, c, g, or t
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggattatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtntatctactttgctttgttaaaacatcatgagagtggaggcctgccacccagaaaggcacatactagtgccttttagtacaattttatgtcatgtagaagaaaatggcaatgttcctcctattgatacagatacaggcatatgtcatcttattgcgttttgctttattgcantttgcaaataatgcattttttacaaatggaaggtttatggcaactctgcgttgagccagtctattggtgccatgtttccaataaaacttctcctttcaaaaaaaaa

SEQ ID NO: 414256 - DNA, 1074 bp, Homo sapiens
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtaggtaaatgggtttttaaaatattttcatgtatttttctagatgaatattcatttacattaatgagcaaggccagagagagaaactctgagaggtcaatcaaaaagtagattttatagttagatgatgttttggtggtatatatttttggaaaactagcagtgatgaaattcatgggtaaattataatgatgtctgtaatta

SEQ ID NO: 414257 - DNA, 2262 bp, Homo sapiens
  misc_feature (1985)..(1985): n is a, c, g, or t
  misc_feature (2156)..(2156): n is a, c, g, or t
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtntatctactttgctttgttaaaacatcatgagagtggaggcctgccacccagaaaggcacatactagtgccttttagtacaattttatgtcatgtagaagaaaatggcaatgttcctcctattgatacagatacaggcatatgtcatcttattgcgttttgctttattgcantttgcaaataatgcattttttacaaatggaaggtttatggcaactctgcgttgagccagtctattggtgccatgtttccaataaaacttctcctttcaaaaaaaaa

SEQ ID NO: 414258 - DNA, 1101 bp, Homo sapiens
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcaggtgagttatcagttccagaatattaagaaatagacgtgttctcatttccaaatggaatataaaaattttgatctaagtcattcttttcagttgatttacttagcaaaaaggattaaccaagatctgccctacttcagagttttggagcagtgtaacttctgttatcagtatgaagtttcatttctgtcagttcaaatccattgtgatgtatggaagaacataaattcgaaagtttaataaatacttagtaaatggct

SEQ ID NO: 414259 - DNA, 2895 bp, Homo sapiens
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagt

SEQ ID NO: 414260 - DNA, 2999 bp, Homo sapiens
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagcctactactgttgactggaagccttaccaataacataaaacaatcgaataacaattatttcatgtattatatgtaaaatatatatactggattcttacagtaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagt

SEQ ID NO: 414261 - DNA, 2844 bp, Homo sapiens
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagt

SEQ ID NO: 414262 - DNA, 1925 bp, Homo sapiens
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggattgggaagtggaaaaaaaattttgattcaaagaaaaacttgggaccgcgggaccct

SEQ ID NO: 414263 - DNA, 1864 bp, Homo sapiens
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaattctgggaggtggatacatcccgaattccagaccgtacaggacc

SEQ ID NO: 414264 - DNA, 1377 bp, Homo sapiens
  misc_feature (1100)..(1100): n is a, c, g, or t
  misc_feature (1271)..(1271): n is a, c, g, or t
agcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtntatctactttgctttgttaaaacatcatgagagtggaggcctgccacccagaaaggcacatactagtgccttttagtacaattttatgtcatgtagaagaaaatggcaatgttcctcctattgatacagatacaggcatatgtcatcttattgcgttttgctttattgcantttgcaaataatgcattttttacaaatggaaggtttatggcaactctgcgttgagccagtctattggtgccatgtttccaataaaacttctcctttcaaaaaaaaa

SEQ ID NO: 414265 - DNA, 4090 bp, Homo sapiens
ttaacaagtgatcgctgctgtctaggattttgtttcttttcgggggaaccttgacttcctttcccaggcaatccctcctgtgctgaactccagaggaaccaggagtcttggggtcttctctggggcagccccaacccccacccccaggctccagccgcgaggactctgtgcacccctcgggccaggcaacagaacttgttccgtggatatttggagcctccacctgccaaacccgagtgattccttttaccaccccccgccccccacccaggatcattcttcccctcctccagctgttgcagcttgagggggaaaaacaagccagccggtggattttctttatttttatttttcgccccgccggggaacggtgaagtgcttcttctgcatgattttggctgaagaatgctctgcatttccttgatttctatggagacctcagagctggttttgcttctgctgacacctcatctagcaccttctctacctcccagggtctttgcctctatctgtggtttggcattgtacctgggtacaggaagcctttgatgaacttaaaaggagagcctggagaatcatcctgatagactttgagtagaaatggctggacatacttcaaaccacatcttaacatggttcgagccatcactagaaggcaagtgctaacagtaaaggcttatttgcattttatttacatttaatggactgagcattggccaatttccatggcagaaaaatatatttcattttctaggcacaacttctggctgtcagacacttgctgcctttgaatcttgcagcaacatcactaaccacatcccagacatatttccaaatttcaacatctacccccaaaacataggtgtctgagagactccagcattttcggacttcttagtcttgagagtgccaggctatttatctcgaccagccaagctctggagagcaatgttgaatccctgagaagagagagcatggggcgtgctgatttaaaaacagaaaatgcaaagttggactgaaaatatccttagtcttccaagcaatctgcttaagggttccaaacttaccttaatttggtgagaaaagaagctgccctatttttctttcttcttcttctacaactggaaccagccatttccgaaaaccaccaccatggaggttgcaatggtgagtgcggagagctcagggtgcaacagtcacatgccttatggttatgctgcccaggcccgggcccgggagcgggagaggcttgctcactccagggcagctgcagcagctgctgttgcagcggccacagctgctgtcgaaggtagcgggggttctggtgggggctcccaccaccaccaccagtcacgcggggcctgtacctcccatgaccctcagagcagccggggtagtcggaggaggaggcgacagcggtctgagaagaagaaagcccactaccggcagagcagcttccctcattgctctgacctgatgcccagtggctctgaggagaagatcctgagggagctgagtgaggaggaggaagatgaggaggaggaggaagaggaggaagaggagggaaggttttactatagtgaagatgaccatggtgatgagtgttcctacacggatctgctgcctcaggatgagggcggtggcggctacagttcagtccgctacagtgactgttgtgaacgtgtggtgataaatgtgtcaggcctacgctttgagacccaaatgaaaactctggcccagtttccagagactttgttgggagaccctgaaaagaggactcagtactttgaccctttgcgcaatgagtatttttttgacaggaaccgccccagctttgatgccatcttgtattattatcaatcaggaggccgcctgaagaggccagtcaatgtcccctttgatatcttcactgaggaggtgaagttctatcagttgggggaggaggccctgttgaagtttcgggaggacgagggctttgtgagagaagaggaagacagggccctccccgagaatgaatttaaaaagcagatttggctcctctttgaatatccagagagctccagtcctgcaaggggcatagccattgtgtccgtcctggtcatcttaatctccattgtcatcttttgcctggaaaccttgcctgagtttagggacgacagggatctcgtcatggcactgagtgctggcgggcatggtgggttgttgaatgatacttcagcaccccatctggagaactcagggcacacaatattcaatgaccccttcttcatcgtggaaacagtctgtattgtatggttttcctttgagtttgtggttcgctgctttgcttgtcccagccaagcactcttcttcaaaaacatcatgaacatcattgacattgtctccattttgccttacttcatcacactgggcactgacctggcccagcaacaggggggtggcaatggtcagcagcagcaggccatgtcctttgccatcctcagaatcattcgtctggtccgagtattccggatcttcaaactctccaggcactccaaaggcctgcagatcctgggccacaccctcagagccagcatgcgggaactgggccttctgatcttcttcctcttcattggggtcatcctcttttctagtgctgtgtattttgcagaggcggatgaacctactacccatttccaaagcatcccagatgcattttggtgggctgtggtgaccatgacaactgtgggctatggggacatgaagcccatcactgtagggggcaagattgtcgggtccctgtgtgccattgcgggtgtcttaaccattgctttgccagtgccagtgattgtctctaactttaactatttctaccacagagagactgaaaatgaggaacagacacagctaacgcagaatgcagtcagttgtccatacctcccctctaatttgctcaagaaatttcggagctctacttcttcttccctgggggacaagtcagagtatctagagatggaagaaggagttaaggaatctctgtgtgcaaaggaggagaagtgtcagggaaagggggatgacagtgagacagataaaaacaactgttctaatgcaaaggctgtggagactgatgtgtgaatctttttccacctgccactgctcccccctcagcatctccaaatatatttatgcatagagagtgcagttatgaaaatgaaatatgcaaatgatccaatgcatacagtagtacactatttaatggttatacatggcataattgttactaaacttgtattacatatcaaataaatgatacatcttggagaagagggaggaataggagcaaatctatctttatatttttattagaatgcaagaattttgcacattaactggaaaagatgttaacagtaaagatggagagagagagtgtgtgcgtgtgtgtgtatatgtgtgtgtgtgtgaagtaaattgtcaatgttagtaattgtgcagtgaagggaaaagttggcattttgaagtatttactatgtaagaactaatgaatctgagcagtcatttatcagtgctttaacagcatatcgtatgtctttggattctgtagttgttttttaaaaattgtaagaaatactgtgtagagaaaaaagaaagtaaattatttaatagactataggtcacaattttatcttggatttaattaaaatttatttttaactggaaattaacttttaaaaaggctgcaagggcctttagaaattgattatattttgttattaattttgggaagacttaacagcaaatgtctaacattatagaataagtgaaattggagaatatgtaataagttttgtttgcaggtaacaggactggatttttttttctttgcactactttatatgctggagattgagagagacttcaaactgtgaatgtttactaatgtaacagttcaatgacaatcattggaagaatgatttctttagtcttattttattgtttttttttcattgtgtgagactaatgatcatgcagataacatcacaggattctctcctcttttaaaatctaaataactgattgacaaaggaattatgaagtaaaatttagcaactga

SEQ ID NO: 414266 - DNA, 173 bp, Homo sapiens
tgtacagtgggaccagcacactgaagtcagctgcccagaggccaccccagagaagggactacagtcaaagaatgcagcatagacagtggggcacagagttttggtatttttaaaactccaaaatcaagatgatgactcaattattcaaaatatgtgattaaaacacttcctga

SEQ ID NO: 414267 - DNA, 2263 bp, Homo sapiens
gacagcaaatacttccgtaaaacagaccatcaagctttccacttagagcccagtgtggccccaatacctttccttgtcgctcctgcgtgccagtccgcctccgcgtggtccggccgctgcgccacgcccccgctcgccccgcccctggatttgctccctcaaagctgaagtgaggccgggctgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcctttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctacttaaggcccagttaatataagtggaatcatcatagtttaaggaatacccagagattgctgctgttctatttattttacagaaagggtagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggcaaaaaaaaaaaaaaaaaaaaaggggcgggcaaaaatatcctggaggggcaaataacggtaccgttttggaaaggggccaaagggggaaaaacaagaacggcgcgtcaaagcggcgggaaacgccttggcttgggggacctcgggggcattcgcaccacgaaaacggaaaatagtagggacgctcgcagggtcgtaaatgg

SEQ ID NO: 414268 - DNA, 2060 bp, Homo sapiens
  misc_feature (2020)..(2020): n is a, c, g, or t
gacagcaaatacttccgtaaaacagaccatcaagctttccacttagagcccagtgtggccccaatacctttccttgtcgctcctgcgtgccagtccgcctccgcgtggtccggccgctgcgccacgcccccgctcgccccgcccctggatttgctccctcaaagctgaagtgaggccgggctgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcctttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctacttaaggcccagttaatataagtggaatcatcatagtttaaggaatacccagagattgctgctgttctatttattttacagaaagggtagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagttgaatacncaggtcatatttatatcacttcggggggggggagtggcgg

SEQ ID NO: 414269 - DNA, 2118 bp, Homo sapiens
gacagcaaatacttccgtaaaacagaccatcaagctttccacttagagcccagtgtggccccaatacctttccttgtcgctcctgcgtgccagtccgcctccgcgtggtccggccgctgcgccacgcccccgctcgccccgcccctggatttgctccctcaaagctgaagtgaggccgggctgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcctttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctacttaaggcccagttaatataagtggaatcatcatagtttaaggaatacccagagattgctgctgttctatttattttacagaaagggtagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggcaaaaaaaaaaaaaaaaaaaaaggggcgggcaaaaatatcctggaggggcaaataacggtaccgttttggaaaggggccaaagggggaaaaacaagaacggcgcgtcaaagcggcgggaaacgccttggcttgggggacctcgggggcattcgcaccacgaaaacggaaaatagtagggacgctcgcagggtcgtaaatgg

SEQ ID NO: 414270 - DNA, 298 bp, Homo sapiens
cttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggcatttgacatgtgtaatctcatttaaccctcatgataaatatgtaatacttta

SEQ ID NO: 414271 - DNA, 2064 bp, Homo sapiens
gacagcaaatacttccgtaaaacagaccatcaagctttccacttagagcccagtgtggccccaatacctttccttgtcgctcctgcgtgccagtccgcctccgcgtggtccggccgctgcgccacgcccccgctcgccccgcccctggatttgctccctcaaagctgaagtgaggccgggctgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcctttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctacttaaggcccagttaatataagtggaatcatcatagtttaaggaatacccagagattgctgctgttctatttattttacagaaagggtagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggca

SEQ ID NO: 414272 - DNA, 2209 bp, Homo sapiens
gacagcaaatacttccgtaaaacagaccatcaagctttccacttagagcccagtgtggccccaatacctttccttgtcgctcctgcgtgccagtccgcctccgcgtggtccggccgctgcgccacgcccccgctcgccccgcccctggatttgctccctcaaagctgaagtgaggccgggctgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcctttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaatatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctacttaaggcccagttaatataagtggaatcatcatagtttaaggaatacccagagattgctgctgttctatttattttacagaaagggtagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggcaaaaaaaaaaaaaaaaaaaaaggggcgggcaaaaatatcctggaggggcaaataacggtaccgttttggaaaggggccaaagggggaaaaacaagaacggcgcgtcaaagcggcgggaaacgccttggcttgggggacctcgggggcattcgcaccacgaaaacggaaaatagtagggacgctcgcagggtcgtaaatgg

SEQ ID NO: 414273 - DNA, 872 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttcctcttagaagaaaattcaacccctctacagaaaaacacttttggcgcgccgcggcctccgaggagagctttcgaaacacctcgtgtggagggcggggcaccagaggtaaggaacaggtgcccacgtgtcccggagaacgcgggcgagcccggtggggacc

SEQ ID NO: 414274 - DNA, 652 bp, Homo sapiens
  misc_feature (1)..(1): n is a, c, g, or t
  misc_feature (54)..(54): n is a, c, g, or t
nggatccccgggcttcaagaattcggcacgagcaaatccaagatggcggccagnggaggctgatgagagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacttaatcaaaagtggtctaggtaacctgtaaagaaaggattaaaaatttaagatgttc

SEQ ID NO: 414275 - DNA, 433 bp, Homo sapiens
gaattcggcacgaggttttggttgctggcttcagttttcggcactaattactggcagacagacctgcccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttc

SEQ ID NO: 414276 - DNA, 2735 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414277 - DNA, 2057 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatccgcggagttgtatgacggtgaacagcgcccaaggggttttccccgattgcaatacaagagatgtttccggggcaaaacaggccgagttacccgt

SEQ ID NO: 414278 - DNA, 1327 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagcagaatgagccctcaccctggctggggtcctagcacaggctgtatctgcagagggtcccagaggaacgctggaccaagagaagtcctgggaagcaggggtgccgtggt

SEQ ID NO: 414279 - DNA, 2869 bp, Homo sapiens
  misc_feature (1)..(1): n is a, c, g, or t
  misc_feature (54)..(54): n is a, c, g, or t
nggatccccgggcttcaagaattcggcacgagcaaatccaagatggcggccagnggaggctgatgagagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414280 - DNA, 2844 bp, Homo sapiens
  misc_feature (12)..(12): n is a, c, g, or t
atttcggcaccngggtgggagcggccacaggaggctgatgagagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414281 - DNA, 2763 bp, Homo sapiens
gctgccgcctactactactaaattcgcggccgctcgaccaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414282 - DNA, 2596 bp, Homo sapiens
gaattcggcacgaggttttggttgctggcttcagttttcggcactaattactggcagacagacctgcccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414283 - DNA, 2579 bp, Homo sapiens
cccccccccccccccccccactcccgcccccatcccaccacaaaccacaccgcacaatctaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414284 - DNA, 2599 bp, Homo sapiens
tggcagaaaaacaaatagaataagagtattccagaaaaacaggagaagaggaatatttcagaaaaataaatagaacaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414285 - DNA, 844 bp, Homo sapiens
  misc_feature (734)..(734): n is a, c, g, or t
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttcaaaaaaaaaaaaaaaaaaattnggggggcccggcccgaagagatttaaaacctgcgggggcggggccaggtaggaacgggccacggccaagaacgcgcgaagggggggtccccaaaagcccggggcgggtca

SEQ ID NO: 414286 - DNA, 2806 bp, Homo sapiens
  misc_feature (12)..(12): n is a, c, g, or t
atttcggcaccngggtgggagcggccacaggaggctgatgagagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414287 - DNA, 821 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagaaacttcagcgttcccaattatggcttctctcagatccagccttgaagttctttgacctcctcaattcacaacctgtagctgactttagccacccacaagtacagaaaataatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttc

SEQ ID NO: 414288 - DNA, 712 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttc

SEQ ID NO: 414289 - DNA, 2875 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414290 - DNA, 1780 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtca

SEQ ID NO: 414291 - DNA, 2168 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcaaaaaaaaaaaaaaaaaaaaaaaaaaaaaaaaaaaaaaaaaaaaaaaaaaaaaaaaaaaaaaaaaaaaaaaaaaaaaaaaggtgtggggggggggggggccaaggaaagagttttaaaaacattggggtggggcgagacgcgggcaccccaagatatagtgatagagtcgagaacaagtggaggcaacaatgggtggttcctcaagaagaaacgctggggcaagcaaaaccagggggtggggcttcccacaccaaaaaaaaagacgccgccgggggaaaccgaggcgttgtggccaaacacacaccgaagggggaactcggagacgacacagcgggggatcacaaacggggcacaagaagcagccaacaaaaatcccgagcacggggat

SEQ ID NO: 414292 - DNA, 2880 bp, Homo sapiens
  misc_feature (54)..(54): n is a, c, g, or t
  misc_feature (66)..(66): n is a, c, g, or t
cgagtatccacgatgacagttagagcgggatggagctatcaaagtcctcgagtngctgtccagcangaggctgatgagagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414293 - DNA, 2779 bp, Homo sapiens
ccacgccaccgtgcattctggggaaggagcagcaccaaatccaagatggcggccagcaggaggctgatgaaggacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414294 - DNA, 2984 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagaaacttcagcgttcccaattatggcttctctcagatccagccttgaagttctttgacctcctcaattcacaacctgtagctgactttagccacccacaagtacagaaaataatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414295 - DNA, 2825 bp, Homo sapiens
  misc_feature (54)..(54): n is a, c, g, or t
  misc_feature (66)..(66): n is a, c, g, or t
cgagtatccacgatgacagttagagcgggatggagctatcaaagtcctcgagtngctgtccagcangaggctgatgagagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggaattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 414296 - DNA, 678 bp, Homo sapiens
ccacgccaccgtgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgagtaactgccacaagcgaaagccaggcggtggcacgtgtcaatttccacagagtcctgctttgcggggtgtctgaatgg

SEQ ID NO: 414297 - DNA, 244 bp, Homo sapiens
ttttaaaaccacggccaggcccaaactggaaaacccccagggcgcttttaaaggttcccccaaatttttccttcaaggggggggggtgtctcaaaaaaaaaaaaaaaaaaaaaagttaagcagacattgtgtgtaaaatttgtgacagaatttttttttttaagctaagcaagccagaagcaattccagtgcaaagtgtggtgtaagaaaaattaattatagtacagtacttggctcaattgta

SEQ ID NO: 414298 - DNA, 1451 bp, Homo sapiens
caaaaagataaaacctacaaagaaaaagagagtgaagaggagagagaaccgtggatcagatataataaaaaaatagatgggatggtagagtgggaacctatttagctgagtgagccactgcctaactgcgtacagagggggatactgataagcaagccagccagccagcattcttcacctgccttcatcttagaatgcctgcagctagattcgaactcttctgtctggacttcagcaggtccttttctagagagcctactgccatcacagaagggacctgctgataacctgcaattgtggtttccccaagcaaaaagtgagctcaccatctgatcactgttcattgaatttacagttgaacatgacccgtgcacactaagcctcgtttggatggcctgtgttcattagacaacagaaaagctaaaaggaatgaactgaataaaagaactcggaagaaatagatgatacaggcaataggaaagaactaaaaaacaaaacagaaaacatgaataggtctcagatgataagacactggattcactaaacaagaacaacatgcctacaaaggaagcgagagagagaaggaacaaatcgataacaagaaacgatgcttggaaataatatgatagctgaaataaagtagtgcatgagaaggctggaagatgtagttcattcttccagcaagtaaaagaaaaatataaagaaatgtaaagtagaagggaaaattaagaaagttagatgatcaacccaggaagtacaaaatctgcctaaagttacaaaaaagaggacaaaaggcattggaggataataaattatcaaagtaatactacaggaaaatttccctagtaaattatcaaagtaatactaggggaaaatttccctgaactacaaaacaaaacaaaacaaaaaacagtagtctcttggttgaatgaaaaagaacccatactactgagtgaaatttcagactatctggacaagtcacttagctatttaatcggttataccacgagatacttatggagggtattagaacaattaatgatagtttcattaaaaggtaagcaaacaactttgggaggccaaggcaggtggatcacgaggtgagttcaagaccagcctggccaagacggtgaaaccccatttctactaaaattagctgggtgcggttgcaggtgcctgtaatcccagctacttgggaggctgaggcaggagaatcacctgaacccgggtggcagaggttgcagggaggcgagatcgtgccactgcactccagcctgggcaacagagtgagactgtctcaaaaaaaaaaaaaaaaaaaaaagttaagcagacattgtgtgtaaaatttgtgacagaatttttttttttaagctaagcaagccagaagcaattccagtgcaaagtgtggtgtaagaaaaattaattatagtacagtacttggctcaattgta

SEQ ID NO: 414299 - DNA, 1412 bp, Homo sapiens
ccgacggcagtaccccggggtaataggtagcgaggccggggtggcgcgtcttcttcgtcgccagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagacccctggtaacttttcacagaaaaaggggggcgcccaaaaaacccccaggggagccccaagtatgcagtacaacgcgttttggtgcaaaagaggcccccaagagagcgctcttaaacagaaccggacgcgcgttctaacaactcgctctgacaacgtaactagcgtcatcgtgtcgaagaccgcccaacaccctgtgctgcgcgagacggggcaatagccacaaacatagcctcccaggaacaagaaacaaacacacagtggagacacaccaccgagctcgtcggagacacgtacctcgacgattacgacaccagcctaaaacggcagagccgagtcgagcgactgcctaacactcacgcaagcgcagcgactgcagcaaggacgcgtcaacaggaagcactgacgacagcacgagctcgcatcgacgcaagggctaactagccagag

SEQ ID NO: 414300 - DNA, 1591 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414301 - DNA, 1624 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414302 - DNA, 1877 bp, Homo sapiens
aaggctaggtaggaggcgggtgttgaatcggccgagggcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagacaaaaaaaaaaaaaaaaaaaaaaaaaaaaaaaaaaaaaaaaaaaaaaaaaaaagagaggggcgcgcgcgcgcccacaaaatattccccccgggggggcgcccacataccgcccgacccccttttttttgaaaaagggggccccctaatagaggaggagcgcgagcttattatatacacggagagagcagcgacggggcgcccgcggattattaaaacaagcgcggcgggaggaggcggggaacaaaccgcgcgcgacaccggcggggaacacctcttgggggagagaaagccaacccctcacctgcgccgggggggcgggcagacaccccaggtggggaccccaccatctccctaaccggagagaattattaaaggcggtcctagggggggaacaaataataaacccttttacagagcgggggataatgcgcggggataaccaatcaccgcggcgataatatgcgcgctggggcgggtgagaaacaatctttgcgtgccacaccagggagcgtcgtgtacttttgtaaaacaatttttattataccacccgcgggggtctccttttttgcttttattaatataccggtgacgaccacaagcaccaggtcgagcggaacaacgcgagacggcagcaccgcacccggaagcgaagcagccgcagaccacgaacaagggagggagaggcggggatgaaaggaaggcggagaaagcaagtagggcgcggagagagaaaagaagacgagagcgggagggaagaagacgtgagcgccgccggagccgggagagagaagcgaaacgaacacaacaacaacaacgacaacactgagcaagacaaacgaaaagcacaacacac

SEQ ID NO: 414303 - DNA, 965 bp, Homo sapiens
ccgacggcagtaccccggggtaataggtagcgaggccggggtggcgcgtcttcttcgtcgccagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414304 - DNA, 1733 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggagggtaggagagcgcgggaaagcgccccagacgccactcgcggcggacggcggccagttcccaggggtttggagccggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414305 - DNA, 1231 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtccccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414306 - DNA, 1866 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggagggtaggagagcgcgggaaagcgccccagacgccactcgcggcggacggcggccagttcccaggggtttggagccgggtgcgcaggcgtggggcctccgggcacggggcgggcccttaacaggcaccgctgcggggactggagtcggcggagaaaaccggggtccccagcgctggggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414307 - DNA, 1498 bp, Homo sapiens
  misc_feature (1035)..(1035): n is a, c, g, or t
aaggctaggtaggaggcgggtgttgaatcggccgagggcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagacaaaataaaatnaatatacaaaaacagggggaaagcatataaagaattaccctaggagggggccacgttacgggtcaccggctttctttaccacgggtgcccatatggaacggcattaataagcaacgactgcgcgctttaacacgctgtgacactgtgaacaactgttaactgagcacttggggacgagcacacatacccgggggggcaacattgtggccaacacccccacagagttttaggcccccagggcaaaattaacctctcagggataagcgggttaaccaacagaccataatcgggcctaaaagactgtaggagccttatatgaattgcgcagccacgataagagatgatcaacaagaatctgcccaggtcgacaccatatctactcgcgcagcgtagctgtcgcgcagagaacacatcacagcaccacccagatcatgacacacgacctacccactgccgatcggag

SEQ ID NO: 414308 - DNA, 1264 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtccccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414309 - DNA, 1916 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggagggtgaggaccacaggcatcggggagaggaggcgcagttactacccggggaagtcgggcgagcagtggtcggggacgctcagtcatgcctctgtgcagccgggcctgagatgtgagggccaggcgccgcaggagccaggaaggggctcctctgggaagctccatctctgttctggaaagcccctcaggaagcgctcaccctgtagccggtctgtgcctgccccaggccagagcaggggacgaaggtttacctcttcccctcctggctttccagcctcaccttctccctgcatcaagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414310 - DNA, 955 bp, Homo sapiens
aaggctaggtaggaggcgggtgttgaatcggccgagggcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggccagaggcctctctggcccaaagcggcctctctggcccagagagg

SEQ ID NO: 414311 - DNA, 993 bp, Homo sapiens
aaggctaggtaggaggcgggtgttgaatcggccgagggcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcctgcgaaccagccctggcggaggtgaggggtgtctgaggagtgatgtggagttaagcgccatcctcaccgcaactgtacgcg

SEQ ID NO: 414312 - DNA, 1026 bp, Homo sapiens
aaggctaggtaggaggcgggtgttgaatcggccgagggcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggggagggggaccttcctcctttgttttggtcggggtaaggtccactttcttcccaggggcagcggttttgggaattggttgccctcttgtgtggcacccctttctgattagaagtaggcgttatcagataattaaaggccccatgaaaaaaa

SEQ ID NO: 414313 - DNA, 757 bp, Homo sapiens
gagctcggtacccttgcatatggcaaggccaagcatccctctggagttgaagagacgaggaagatgaaccacgtgacgaaatagaaaaagctacctatggagttgtgccttggccttgccatatgcaattgcatatggcgaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414314 - DNA, 1418 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414315 - DNA, 2239 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggagggtaggagagcgcgggaaagcgccccagacgccactcgcggcggacggcggccagttcccaggggtttggagccgggtgcgcaggcgtggggcctccgggcacggggcgggcccttaacaggcaccgctgcggggactggagtcggcggagaaaaccggggtccccagcgctggggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggagggtgaggaccacaggcatcggggagaggaggcgcagttactacccggggaagtcgggcgagcagtggtcggggacgctcagtcatgcctctgtgcagccgggcctgagatgtgagggccaggcgccgcaggagccaggaaggggctcctctgggaagctccatctctgttctggaaagcccctcaggaagcgctcaccctgtagccggtctgtgcctgccccaggccagagcaggggacgaaggtttacctcttcccctcctggctttccagcctcaccttctccctgcatcaagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414316 - DNA, 2099 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggtggggagctttcggcctgacttacaccacaggatctgggagtgttggctgaagatgtgtgctctcgggaggagtggggccgggcggggttcctggtgcctgaaaaaggccaaatgtgggcaaaaatacggtcacttggagtaagtagttgcaggggctggaagggcctggaggaggctcttgaaagggctgttgttggccgggctgaggctggcaaggcagagcccagctccactgccttcatcagggagagtgggtgaggccccagggtctgtccactcaaggctgcggggtgggagccctgggacccctctgccggctgcttgtggttctgctcctctggcattaggggacctgcctattccttgctgaacggagaccctcccacccccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414317 - DNA, 1479 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414318 - DNA, 1527 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414319 - DNA, 1548 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414320 - DNA, 1605 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagacaaaaacacaaacaacacagaagcaacaaaacaacaaagaaacaaaacaaacaacacacgggagaccaacggccggggggagaaaagacgcga

SEQ ID NO: 414321 - DNA, 1538 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagacaaaaacacaaacaacacagaagcaacaaaacaacaaagaaacaaaacaaacaacacacgggagaccaacggccggggggagaaaagacgcga

SEQ ID NO: 414322 - DNA, 1029 bp, Homo sapiens
gtcagtagagcgccgtggtgatcggacgaggccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414323 - DNA, 1024 bp, Homo sapiens
aaggctaggtaggaggcgggtgttgaatcggccgagggcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414324 - DNA, 1658 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414325 - DNA, 1691 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414326 - DNA, 948 bp, Homo sapiens
gggctaggtacgaggcctgggtggtgccggcccgcagtgcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414327 - DNA, 1025 bp, Homo sapiens
gttaagggatatgtcgaccacgcagtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414328 - DNA, 1983 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggagggtgaggaccacaggcatcggggagaggaggcgcagttactacccggggaagtcgggcgagcagtggtcggggacgctcagtcatgcctctgtgcagccgggcctgagatgtgagggccaggcgccgcaggagccaggaaggggctcctctgggaagctccatctctgttctggaaagcccctcaggaagcgctcaccctgtagccggtctgtgcctgccccaggccagagcaggggacgaaggtttacctcttcccctcctggctttccagcctcaccttctccctgcatcaagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414329 - DNA, 2299 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggagggtaggagagcgcgggaaagcgccccagacgccactcgcggcggacggcggccagttcccaggggtttggagccgggtgcgcaggcgtggggcctccgggcacggggcgggcccttaacaggcaccgctgcggggactggagtcggcggagaaaaccggggtccccagcgctgggggtgggtgagggtcgctcattttcccgggacggtgacgggtactgggcgtcgccaggccccggccccgctagagccacccttggagcccgcccgcggccggccttgggggcttcggctcaagcgcgtcttcttcgtcgccagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggagggtgaggaccacaggcatcggggagaggaggcgcagttactacccggggaagtcgggcgagcagtggtcggggacgctcagtcatgcctctgtgcagccgggcctgagatgtgagggccaggcgccgcaggagccaggaaggggctcctctgggaagctccatctctgttctggaaagcccctcaggaagcgctcaccctgtagccggtctgtgcctgccccaggccagagcaggggacgaaggtttacctcttcccctcctggctttccagcctcaccttctccctgcatcaagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414330 - DNA, 1594 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcgagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414331 - DNA, 2038 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagacccctggtaacttttcacagaaaaaggggggcgcccaaaaaacccccaggggagccccaagtatgcagtacaacgcgttttggtgcaaaagaggcccccaagagagcgctcttaaacagaaccggacgcgcgttctaacaactcgctctgacaacgtaactagcgtcatcgtgtcgaagaccgcccaacaccctgtgctgcgcgagacggggcaatagccacaaacatagcctcccaggaacaagaaacaaacacacagtggagacacaccaccgagctcgtcggagacacgtacctcgacgattacgacaccagcctaaaacggcagagccgagtcgagcgactgcctaacactcacgcaagcgcagcgactgcagcaaggacgcgtcaacaggaagcactgacgacagcacgagctcgcatcgacgcaagggctaactagccagag

SEQ ID NO: 414332 - DNA, 1105 bp, Homo sapiens
aaggctaggtaggaggcgggtgttgaatcggccgagggcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414333 - DNA, 1513 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414334 - DNA, 1446 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414335 - DNA, 1583 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgagggactgctggcttcaagatgcgagctggtgttctgaggcccgtggcagctggacagctggggcccgggcagtaagcgcacgcacgagggggggctccgaggtttgcaccccctcggcgggggggccgcgggccccaaaagttaccgcaaaaaaccttgggcaaagggcc

SEQ ID NO: 414336 - DNA, 1185 bp, Homo sapiens
gcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaaggcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414337 - DNA, 783 bp, Homo sapiens
  misc_feature (1)..(1): n is a, c, g, or t
ntcggtaccgacgctctctctgtggggccgggcggggttcctggtgcctgaaaaaggccaaatgtgggcaaaaatacggtcacttggagtaagtagttgcaggggctggaagggcctggaggaggctcttgaaagggctgttgttggccgggctgaggctggcaaggcagagcccagctccactgccttcatcagggagagtgggtgaggccccagggtctgtccactcaaggctgcggggtgggagccctgggacccctctgccggctgcttgtggttctgctcctctggcattaggggacctgcctattccttgctgaacggagaccctcccacccccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 414338 - DNA, 4069 bp, Homo sapiens
aaaaactttgggtgggatgggtgtccctgtccccagcccaccatggcttggggtgggtatctgtggccgttagggtgcgtcccctgctcccccgcccagggccagggaccactcgtctcccactgggggaaaaagggggtcccgggtgggcgactagtacgtgtgaagctgagctcagggccggacctggggagcgggggactccgctcgggcaggaggcagcggccagggctgggccagggcgagagtcggtcctcccggtgctgggctccccgtctgccttgaggggtgtgcatggatggagggtgcctgaggctgcaggcaggggatgaccgggacaggcctgggctggggcagttggaggtatgggcactggtaggggacagagggttagggatcatgttggggggccagggacagtggaggaagggcccatggaagatggggctgtttggtttgaggctggagtgcttcctttgaaatttaattactgttttttaagtggtagggctcacagactgtgtgaagtcctgtgtgaagtgctggtgtggccacctacccaggtgtccctcccttttgttttggaggcctgtgtccttgtccaggggcagccctccttcccaggtgtggccagaagaaccccccatcccaagacttgaaatgtctgttgctcacctctgtccctccagaactcggcttccccatcttcacttgcaaaacaagtgcagccctgcgcccatcagcaccccctccggtgtgcacacaggccagtgagcggtggccgaccagcgcaccccactcccccaacctccacaacccatcaagcggaggccgcctccgctaggggaggaccatgtgctgcaccctggcctggggacctacagggtgtgggttagacgcattcccactgggcggctcctttctgccccgaagcccacccctgtggcgaggccctaggagacctcccgtggggccgcctctacagacagcactcagcctcctgggctgcctccagccaggcccagcacatgcctgccctccagaaaaatacgttgctttccagaaggaggtgggggaccatgggcaggcactgtggacgctaacctcggcccctccacccgttcctcagggcccacgtccagggggaccaagacctgcattcctagggccgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttgagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttacggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacatttgtcatgtcagccagccagctccgtgggtgagagtgtgcgtgtgcgcgtgtctgtgtgtatgtgcgtgtgtgtgcgtgtctgtgtgtgtgcacgtctgtgcgtctgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 414339 - DNA, 2093 bp, Homo sapiens
ctccatagtgtgtgcccacgtagaggcgccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttacggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacatttgtcatgtcagccagccagctccgtgggtgagagtgtgcgtgtgcgcgtgtctgtgtgtatgtgcgtgtgtgtgcgtgtctgtgtgtgtgcacgtctgtgcgtctgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 414340 - DNA, 1113 bp, Homo sapiens
taggggcgcgcccgcgcgcccgcgcgcgtcgaggcgcgcacggcagcgccgccgcccggggtggagggcgtggcgcgtgctgggtaggcgtcgtggtgcgtgtctgtgtgtgtgcacgtctgtgcgtctgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 414341 - DNA, 422 bp, Homo sapiens
caatggcagccggcccaatggcagcctactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 414342 - DNA, 3603 bp, Homo sapiens
aaaaactttgggtgggatgggtgtccctgtccccagcccaccatggcttggggtgggtatctgtggccgttagggtgcgtcccctgctcccccgcccagggccagggaccactcgtctcccactgggggaaaaagggggtcccgggtgggcgactagtacgtgtgaagctgagctcagggccggacctggggagcgggggactccgctcgggcaggaggcagcggccagggctgggccagggcgagagtcggtcctcccggtgctgggctccccgtctgccttgaggggtgtgcatggatggagggtgcctgaggctgcaggcaggggatgaccgggacaggcctgggctggggcagttggaggtatgggcactggtaggggacagagggttagggatcatgttggggggccagggacagtggaggaagggcccatggaagatggggctgtttggtttgaggctggagtgcttcctttgaaatttaattactgttttttaagtggtagggctcacagactgtgtgaagtcctgtgtgaagtgctggtgtggccacctacccaggtgtccctcccttttgttttggaggcctgtgtccttgtccaggggcagccctccttcccaggtgtggccagaagaaccccccatcccaagacttgaaatgtctgttgctcacctctgtccctccagaactcggcttccccatcttcacttgcaaaacaagtgcagccctgcgcccatcagcaccccctccggtgtgcacacaggccagtgagcggtggccgaccagcgcaccccactcccccaacctccacaacccatcaagcggaggccgcctccgctaggggaggaccatgtgctgcaccctggcctggggacctacagggtgtgggttagacgcattcccactgggcggctcctttctgccccgaagcccacccctgtggcgaggccctaggagacctcccgtggggccgcctctacagacagcactcagcctcctgggctgcctccagccaggcccagcacatgcctgccctccagaaaaatacgttgctttccagaaggaggtgggggaccatgggcaggcactgtggacgctaacctcggcccctccacccgttcctcagggcccacgtccagggggaccaagacctgcattcctagggccgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttgagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttacggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacatttgtcatgtcagccagccagctccgtgggtgagagtgtgcgtgtgcgcgtgtctgtgtgtatgtgcgtgtgtgtgcgtgtctgtgtgtgtgcacgtctgtgcgtctgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 414343 - DNA, 2000 bp, Homo sapiens
agagagagagaaccacagagagagagagagagagagagagagagagagaggcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttacggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacatttgtcatgtcagccagccagctccgtgggtgagagtgtgcgtgtgcgcgtgtctgtgtgtatgtgcgtgtgtgtgcgtgtctgtgtgtgtgcacgtctgtgcgtctgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 414344 - DNA, 250 bp, Homo sapiens
cctgcttcagtttggcctgacaggcagccgagctcagcccacagagaccccattgtgcacaccccacaagtccaacgagaagatgggacggaagcgcgtcctcaggctcctgcttctgggccgcagagttggaggccagggccacagccgagcccggcttgtggaggcacaggtcagggctcacacagcagtctgggggacattgcagccgcttcggagaaggccccgggctccctccctgggcttgagc

SEQ ID NO: 414345 - DNA, 589 bp, Homo sapiens
gcgatgggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggaggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggttagtcacaaacactttatgtcaccaggtgagcagtggaggaaagggaacagcattgggcagtggtgcccagctaggataggactgggttggcttcatagggt

SEQ ID NO: 414346 - DNA, 1188 bp, Homo sapiens
ttccaggttggctggctcctctggctgatggcatgttgaggtacatgggccagcggcagcgatgggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggaggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattactgaagatccggatattttctactttacacctttctctgccttgtatctgaaagggctctaaaatgctgtatcatgtttta

SEQ ID NO: 414347 - DNA, 559 bp, Homo sapiens
tgtcatgttttgatatcagatattctggttgtgttaaaataattttgaggattttcttcttatactgtgttctagagtgggtaaaaaagccctagtctcactatcagtgtttaagtgaacacatcagtgacatcatctggactctcctttgtttttgctggtttggagttaggacatctagaagtttttttctttttttcctttttttgtatggttattgcttgttctttgttttgtgtcaaatttaacctgttttctcttagcaaatcacagctcatgcagattttcaaacacattagccttgttatacaaagtgttctttcatcattctattaaatttccattttcattccagttatagttatttctgctgtgcctttgttaatgaataagtttaaacagtggatgtttagcatcactagccttccccttccatctcccttaatcaggaccttggtataatttatcaggtattttttaaggttctaatttacttatatatattgtttctgtattcttttgtttcttttcttaataaattcttaaacctgtgtaacac

SEQ ID NO: 414348 - DNA, 7539 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagagagacagagtctcgctgtgttgcccaggctggagtgcagtggcgcgatcttggctcactgcaacctccgcctcctagattccagcaattcttctgcctcagcctcccaagccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414349 - DNA, 7603 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagagagacagagtctcgctgtgttgcccaggctggagtgcagtggcgcgatcttggctcactgcaacctccgcctcctagattccagcaattcttctgcctcagcctcccaagccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatgacttctagttgtctgcagttttctgcagttgttgtgatgtttctcttcgtctgatggtggttctg

SEQ ID NO: 414350 - DNA, 7931 bp, Homo sapiens
  misc_feature (12)..(12): n is a, c, g, or t
  misc_feature (30)..(30): n is a, c, g, or t
  misc_feature (337)..(337): n is a, c, g, or t
  misc_feature (5829)..(5829): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagatgaaactcattccctgccctcagacacatcctattccgaacaggaagactctgaggatgaagatgccatctgcccagctgtgagctgcctgcagccagaaggagatgaggtcagtgaggtttgggccatagaggacgtgctttcccttaactcagaaaccctgtaagctagacctcatctcgctgggtctttctcctctgcttatctgctttgagctgatctgaatggattgctcagcccttcccccactgatatctgtgctcttaccatcgttcctgggtctcctcccttttcttgaagaaactcttgntcttccctttttccttttcttgctcttccagctttcaccttcccggcgctaagaaggtgggagggatgctgatgtgatgccctttggcttacttatcacagggcagcgctgtcttaaccccaaagcagacacgacttgaagaatgactttgactcggttgctttggctagggggccagctacactcatttggcttagctgttgtgccagaggtcccagtggtgggacagtggctgttattggcaaacggcctgaatttcttgaggctggcctgcccaattttgaatccattttttcctctgaaaaccccatcttcctgctctttgtaaccaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414351 - DNA, 6634 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacat

SEQ ID NO: 414352 - DNA, 7732 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgagctttcaccttcccggcgctaagaaggtgggagggatgctgatgtgatgccctttggcttacttatcacagggcagcgctgtcttaaccccaaagcagacacgacttgaagaatgactttgactcggttgctttggctagggggccagctacactcatttggcttagctgttgtgccagaggtcccagtggtgggacagtggctgttattggcaaacggcctgaatttcttgaggctggcctgcccaattttgaatccattttttcctctgaaaaccccatcttcctgctctttgtaaccaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414353 - DNA, 4420 bp, Homo sapiens
caccgcagccttgaaatcctgggtttaagtaatcctcctgctttagtttgtcaaatagttgggactacagttgtgtgccaccatggctggctaagttctttaattttgtagagaggagatcttgcttgtgttgaccaggctggtgttaaactcctggcctcaagtgatcttcctgccttggccttgcaaattgctgggatttacaggcgtgagccactgtacccgccctaaaacatgtcaggtcttagcatttttatatttaagttcaactctaggcacttgtttaaaaaactccgtgttcagccaccaccctgcaaaaatcaaatcaacaaatttgttaataatttaaagcattgcaaacatttgtaagttacatttctagacaagaactgacaaaaccagtctcctctgaatttcataccagtagtaataaacataatgattacagaaaatatgacttttttcttcattcctaggccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414354 - DNA, 4523 bp, Homo sapiens
  misc_feature (11)..(11): n is a, c, g, or t
tgatgcacaantgactgcactttacgtaattatcaatttggagggacagaggtgtgaatgttttacaataccaaactttaaaaaaaatctattataaaaactgcaactcatctccctaacatttttaaatggtggtattatgtttgcacaaacagattaatacattaaattaagccaagatcttaaagactggctaagttctttaattttgtagagaggagatcttgcttgtgttgaccaggctggtgttaaactcctggcctcaagtgatcttcctgccttggccttgcaaattgctgggatttacaggcgtgagccactgtacccgccctaaaacatgtcaggtcttagcatttttatatttaagttcaactctaggcacttgtttaaaaaactccgtgttcagccaccaccctgcaaaaatcaaatcaacaaatttgttaataatttaaagcattgcaaacatttgtaagttacatttctagacaagaactgacaaaaccagtctcctctgaatttcataccagtagtaataaacataatgattacagaaaatatgacttttttcttcattcctaggccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414355 - DNA, 6686 bp, Homo sapiens
  misc_feature (12)..(12): n is a, c, g, or t
  misc_feature (30)..(30): n is a, c, g, or t
  misc_feature (337)..(337): n is a, c, g, or t
  misc_feature (5829)..(5829): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagatgaaactcattccctgccctcagacacatcctattccgaacaggaagactctgaggatgaagatgccatctgcccagctgtgagctgcctgcagccagaaggagatgaggtcagtgaggtttgggccatagaggacgtgctttcccttaactcagaaaccctgtaagctagacctcatctcgctgggtctttctcctctgcttatctgctttgagctgatctgaatggattgctcagcccttcccccactgatatctgtgctcttaccatcgttcctgggtctcctcccttttcttgaagaaactcttgntcttccctttttccttttcttgctcttccagctttcaccttcccggcgctaagaaggtgggagggatgctgatgtgatgccctttggcttacttatcacagggcagcgctgtcttaaccccaaagcagacacgacttgaagaatgactttgactcggttgctttggctagggggccagctacactcatttggcttagctgttgtgccagaggtcccagtggtgggacagtggctgttattggcaaacggcctgaatttcttgaggctggcctgcccaattttgaatccattttttcctctgaaaaccccatcttcctgctctttgtaaccaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaaggatgggccagtactggcatctcaggtacaggtgacttcctgtctgtcctggggaagctcgttgttgaaactgctctctccaaatgttgagtaaggagggacctggggagcttcgatgatcagcagaccctctggggaaagtgaggcaaatactgtcacaggatccacctctgcaggaagctggattttcgttgtgaagttcttagagacaaggccaccttcttgctgtgtctcttcatgtttgccagacacctccacgtatccatctttggtattcaccatcaactcctatggcctgaagctgtgcaaaatctacacactactttaagatcccg

SEQ ID NO: 414356 - DNA, 2522 bp, Homo sapiens
tcaagaaggaagattattagtgtggttcctcaggagcctgtaggtcacaggatagacataaacacctagacagaaactattatagtagttagtcattcagggatttggtgaaaggaagactcttagtgggcacctctccatcttctggtattggttggttaattggaagggtaatcacgtctttaacattcctttttccagtgatcctttggtagcattaacagtgataggggaaggaagtatgttaaacccaaactggttgtcttatacaagactgggaggggagtggttaagatgcagtatttttttcccgtgtagattgggggatcatctgatttctaatttacatgttctctttagcttcattagttttagtaataggtgacccataggcgaaaattgaactttcctatcttccacccagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414357 - DNA, 1960 bp, Homo sapiens
  misc_feature (1)..(1): n is a, c, g, or t
  misc_feature (6)..(6): n is a, c, g, or t
  misc_feature (8)..(8): n is a, c, g, or t
  misc_feature (17)..(17): n is a, c, g, or t
  misc_feature (31)..(31): n is a, c, g, or t
ntcgtncntcagctgcnaacactctgttcantgtccttggggtggctcgagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414358 - DNA, 1110 bp, Homo sapiens
cagctgtgagctgcctgcagccagaaggagatgaggtggactgggtccagtgtgatggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414359 - DNA, 3761 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagcacattccacatatacaaagcgcaagggaaggctacactggccgacgatgatatcgaccaagtaaatatcgtgcatggagcagacaagctcctatgactggccatgttgtcagaaacacagtcgaactagtcatgatgactcctcttcctcaggtgagaagtttgcacttacacaatctcggagaggaaagtctaagacaagattccttggcaggcattgtcagataccatattccactgtgaaatcctcctcaatagtgcttatagtctaca

SEQ ID NO: 414360 - DNA, 2496 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatgtatgtacatatatactgctttgatttaggattttaatagcttttggagaaaagtgtacctgaagacccatttttagttgaggcctcactctagtaggcattgtcacacagaaagcagaatgaaactttaatttg

SEQ ID NO: 414361 - DNA, 476 bp, Homo sapiens
gtgaaaaagcagacttctctttctttgggaaggttggacagttatctccagcttaaacacagagcacaatgattggtctatggcaagtgctcagtagctgcggttattatgcatgtggaagacatgtagaaatagctgagatatttggagctgctttgggacctgagtaaaagaatgttaattttttcttattttactgattaaaaatgaataattcaattggacacaccttttctagagttggtttaatgaaatttccctggatcctgttaatatcgtgtctttgagagaggaaaatatttacaaataggtgaagctgtttaaactcacagttaatacggttccaaggagtcttaaagagaaatgtgtgagagttaataggcactgttctgcaagaaaacagtgcagataattttcaacaggaatagacaatgtcatttgaaaaaaattatttgccatactgaatttcctttgaa

SEQ ID NO: 414362 - DNA, 406 bp, Homo sapiens
aaaaactccgtgttcagccaccaccctgcaaaaatcaaatcaacaaatttgttaataatttaaagcattgcaaacatttgtaagttacatttctagacaagaactgacaaaaccagtctcctctgaatttcataccagtagtaataaacataatgattacagaaaatatgacttttttcttcattcctaggccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactaggtatgcgcttctgactgcgtgagtttggattctttggcacctatgtttggaaacctgttgtgact

SEQ ID NO: 414363 - DNA, 7431 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414364 - DNA, 4724 bp, Homo sapiens
accaggatgtggacgtcaaatactttgcaaggtgtgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414365 - DNA, 6410 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttcc

SEQ ID NO: 414366 - DNA, 4037 bp, Homo sapiens
agctcctaccccacgacctcctaccccaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414367 - DNA, 5548 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatcccggtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagggggatccttagatcgaccacagcagca

SEQ ID NO: 414368 - DNA, 2427 bp, Homo sapiens
gtttattatattgtggctttaggcacattaaacctcacttcaactgaaggtaatttgtaatttaagaaggagagggtagtagtggtattaggggcagtccttctatttgtctcataaacccaaatgtgaatgtgaaacaccctttgttgttatcattttgatttggtctggtcttttacaggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 414369 - DNA, 4134 bp, Homo sapiens
  misc_feature (12)..(12): n is a, c, g, or t
  misc_feature (30)..(30): n is a, c, g, or t
  misc_feature (337)..(337): n is a, c, g, or t
ttcagtctgttnaaggataccccgttgtgnatttctacctgtatgaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttngcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacagaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccatgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttataaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccagggcgaggggtggtcctcagtgtcagagcattagtgctcatgcatcctgacttgcatatagtccagccccgacatgtgtcgggggatcctc

SEQ ID NO: 414370 - DNA, 575 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaa

SEQ ID NO: 414371 - DNA, 577 bp, Homo sapiens
  misc_feature (1)..(1): n is a, c, g, or t
  misc_feature (28)..(28): n is a, c, g, or t
ngctcgccgaaaacaagccggacgcganaggaaggacagacccagtctctgtccttatggagctaagggggagacggacattaatcaagatgccatatgaaatttcagctgggactcagtgctgtgaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaa

SEQ ID NO: 414372 - DNA, 856 bp, Homo sapiens
acatgtaagtgctacgcaagtaacgccttttgacccacagtttgggaccttaggccgcaggcctctcttaatatccaccgctacagtatcacagagttaattacaccagacctgcactaaagggaataatagaaagattggtctttggcagaagagaaatgatcctgcatggcagctttaagatgcgtggaaaagtgaagaccaaagaaaggagaaataagatgagatcatgatgcagccgtccttttggatttctttttaataatgtgtgacccttcacctttgatcccctgacctgcattaccttggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414373 - DNA, 698 bp, Homo sapiens
cccccccccaccaccccccgcgggaggggtgtcatcactaaatatctccaacggaagaaaattctaagatcatgatgcagccgtccttttggatttctttttaataatgtgtgacccttcacctttgatcccctgacctgcattaccttggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414374 - DNA, 721 bp, Homo sapiens
  misc_feature (35)..(35): n is a, c, g, or t
  misc_feature (58)..(61): n is a, c, g, or t
cttggtgtgtttggatttatttaattattgtttgngtaatgtgataaaaaaaaaaaannnntttcagtcttaaaattttggtagcagaaagcaaatgtgcaaagagcaatggaaaacaagtcagaagctgctgtctgattccagaggaactcgtattttatgttaaaaaaaatgctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414375 - DNA, 1102 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaaaaaaaaaagtatattgtttattaatataatgtgtagatgggaccataaagtattgatacgtatattatggcggagaaagcaacaaaaaaaaggggggggttattatgtgtggggagagatgcaattttagaagggttaataagtatttgagggggggaaggggagatgcgtttttggactttgggatatacacaaagggaaattggttatagggggggagaaaa

SEQ ID NO: 414376 - DNA, 761 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaagtctccaatcacactctaatgacattaaataacgtgtcgcccgtccaggaagggaaatggttcgcacgattcctcttttgccaataattttacaacctctagtttagggtttgttagaaaatctccctgaaagggggaaagcattgtttctcggctttattggacgggagtttcccttgggtggct

SEQ ID NO: 414377 - DNA, 544 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagatgatcatgggaacagcaatagtagtcatgtaaaaatctttttaccgaaaaagctgcttgaatgtctgccgaaatgttcaagtttaccaaaagagaggcaccgctggaacactaatgagctcacttacaggccctccaagcagtacaacgagaggtctggaagccgctggccgctgcttatcaggaccagctagatcagccagtgataccacaccccttccgtgtcggtgacgccgtgtgggtacgccggcaccagactaagaacttggaacctcgctggaaaggaccctacaccgtcctgctgaccacccccaccgctctcaaagttgacggcatctctgcgtggatacacgccgctcacgtaaaggcggcgacaactcctccggccggagcaacatggaaggtccaacgttctca

SEQ ID NO: 414378 - DNA, 3105 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414379 - DNA, 3051 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataactcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414380 - DNA, 3058 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaatttttctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414381 - DNA, 3051 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414382 - DNA, 3051 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaattctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414383 - DNA, 2696 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaatttttctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414384 - DNA, 8320 bp, Homo sapiens
  misc_feature (1432)..(1432): n is a, c, g, or t
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcngagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagccccctggtggaccataggctgtacaaaaggagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggagccaaagaaatctgatgtttttaacaattaaactgctaatgttaaattgagagaataaagttcgtatttgctgatgccagtttaaaattcccaggttacgtctgaggatcagttggtgtaaagctgagatgttttttcttggttctggctgccaactgtgagttaaaactcaaggcttgttgtgaagcctaaaaatattcacaaataagcttttaaactggtgtctttggaaggaaggtagatacaaaaagattgtgggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgctttaaccctcacattttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcgaggcaaaaatgcacttccactgaaacgaagcatttctgaccgctttttcttggttatgaatcttaatttcgaatataagatgataggtaagcgcagctttcttggataatctgaattcccaagtgccaggagtaggatttcattataaaattaatagctaatcttattctatctcctgaagatttaattgctattgttacccattcgaaatcagctgtactgtgtgaacgaaataaagacaataatacgaacccctctctggctgcacggtcgcttatggcagttccacacagtagttggcgcccaatggggggtccctgagacttgcatgtaaaactagtctagatgtcttctttttttgtaagttttatttttgtaattgtgcatgtaaagcatcattgaatcaatggatctgttgaagaactcagctgctggaaaccatgcaaaatgttttgaattgcccttaaaatatggaaaatgttttctgaatgctttatattctttctgctgtaaattaaaaatgaagaaaatttccccata

SEQ ID NO: 414385 - DNA, 7966 bp, Homo sapiens
  misc_feature (1432)..(1432): n is a, c, g, or t
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcngagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagccccctggtggaccataggctgtacaaaaggagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggagccaaagaaatctgatgtttttaacaattaaactgctaatgttaaattgagagaataaagttcgtatttgctgatgccagtttaaaattcccaggttacgtctgaggatcagttggtgtaaagctgagatgttttttcttggttctggctgccaactgtgagttaaaactcaaggcttgttgtgaagcctaaaaatattcacaaataagcttttaaactggtgtctttggaaggaaggtagatacaaaaagattgtgggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgctttaaccctcacattttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcgggctgctttccttgaaacgaaacttctgacggtttcctgggtagaatctaattcgaatttggagaggaacccaatcgggaaacggatcccaggcggacggatccttacataagggacttaaacccgtgcgtgtgccgcggcgggggcccagcatagacctctggggcggtccccatggccaggggc

SEQ ID NO: 414386 - DNA, 963 bp, Homo sapiens
acatgtaagtgctacgcaagtaacgccttttgacccacagtttgggaccttaggccgcaggcctctcttaatatccaccgctacagtatcacagagttaattacaccagacctgcactaaagggaataatagaaagattggtctttggcagaagagaaatgatcctgcatggcagctttaagatgcgtggaaaagtgaagaccaaagaaaggagaaataagatgagatcatgatgcagccgtccttttggatttctttttaataatgtgtgacccttcacctttgatcccctgacctgcattaccttggtcttaaaattttggtagcagaaagcaaatgtgcaaagagcaatggaaaacaagtcagaagctgctgtctgattccagaggaactcgtattttatgttaaaaaaaatgctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414387 - DNA, 948 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414388 - DNA, 1057 bp, Homo sapiens
  misc_feature (1)..(1): n is a, c, g, or t
  misc_feature (28)..(28): n is a, c, g, or t
ngctcgccgaaaacaagccggacgcganaggaaggacagacccagtctctgtccttatggagctaagggggagacggacattaatcaagatgccatatgaaatttcagctgggactcagtgctgtgaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtcttaaaattttggtagcagaaagcaaatgtgcaaagagcaatggaaaacaagtcagaagctgctgtctgattccagaggaactcgtattttatgttaaaaaaaatgctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414389 - DNA, 691 bp, Homo sapiens
aatcgaaccgcgacgcggcctgatcgcataaatagaaaaaaacttatggacacaagcagagatcatgatgcagccgtccttttggatttctttttaataatgtgtgacccttcacctttgatcccctgacctgcattaccttggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414390 - DNA, 8307 bp, Homo sapiens
  misc_feature (108)..(108): n is a, c, g, or t
  misc_feature (1429)..(1429): n is a, c, g, or t
aacctctgcggatgatgacatggcttcactcgtgtttcattcaacaagcatgtgcagtgaccacagatttggggatcttgaaatgatgtcttctcaaaatagcgaggngagtgagaaagagaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcngagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagctgacatggttagccttgaagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggagccaaagaaatctgatgtttttaacaattaaactgctaatgttaaattgagagaataaagttcgtatttgctgatgccagtttaaaattcccaggttacgtctgaggatcagttggtgtaaagctgagatgttttttcttggttctggctgccaactgtgagttaaaactcaaggcttgttgtgaagcctaaaaatattcacaaataagcttttaaactggtgtctttggaaggaaggtagatacaaaaagattgtgggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgctttaaccctcacattttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcgaggcaaaaatgcacttccactgaaacgaagcatttctgaccgctttttcttggttatgaatcttaatttcgaatataagatgataggtaagcgcagctttcttggataatctgaattcccaagtgccaggagtaggatttcattataaaattaatagctaatcttattctatctcctgaagatttaattgctattgttacccattcgaaatcagctgtactgtgtgaacgaaataaagacaataatacgaacccctctctggctgcacggtcgcttatggcagttccacacagtagttggcgcccaatggggggtccctgagacttgcatgtaaaactagtctagatgtcttctttttttgtaagttttatttttgtaattgtgcatgtaaagcatcattgaatcaatggatctgttgaagaactcagctgctggaaaccatgcaaaatgttttgaattgcccttaaaatatggaaaatgttttctgaatgctttatattctttctgctgtaaattaaaaatgaagaaaatttccccata

SEQ ID NO: 414391 - DNA, 1081 bp, Homo sapiens
gagaagattagcatggcccctgcgccaaggatgacacgcaaattcgtgaagcgttccatatttctgttttatcctctgtgaaatgtagatactgtgtgtctcccacttgctttttagggttgttgggaggataaatgaaactgtatgacagacacactgggaactcagaagaaaggtgctgttgaaactgaacctcatcctatggctgtgccgttggcaggcataaccggtgtgctgagaggcagtggtagtgaaccccgtggtgaaaggccaggaccatgggctctggagccaggctgccttggttcgaatcccacctcgacctcttgcaagtggtctgaccacagcaaatcacccaacctctctgtgcctgagtttccccctctttaaattggggatgataatagtacccactaaaggatcctggtcttaaaattttggtagcagaaagcaaatgtgcaaagagcaatggaaaacaagtcagaagctgctgtctgattccagaggaactcgtattttatgttaaaaaaaatgctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414392 - DNA, 888 bp, Homo sapiens
aaaaaatttttgtggcctcttaaagataaaacctacaacccaataaaagtcatgctgtaacgattgcaaaaagaccattgtatgagacccagttttggattatcataggcgaagaagtcagacatatatggttgtatgtacatgtgtatagtatgtgggtgggggtagatacatacctgttcatctgtatacgtatgtgtgtgtttaatatatactttagtttgcctttacccagatgtctcctcctctctctgcctctggaaatggggcaaatttttcttcagttaaaaacagaaatagaagcgacggttttgacccattttacacctatttatttcaggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaa

SEQ ID NO: 414393 - DNA, 1172 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatctccagtgcataggacagtgctgacacagtgcagagtctaaataaacgctgttgaacgaaaaaaaaaagtatattgtttattaatataatgtgtagatgggaccataaagtattgatacgtatattatggcggagaaagcaacaaaaaaaaggggggggttattatgtgtggggagagatgcaattttagaagggttaataagtatttgagggggggaaggggagatgcgtttttggactttgggatatacacaaagggaaattggttatagggggggagaaaa

SEQ ID NO: 414394 - DNA, 561 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaaaaaaaaaaaaactctccaggcgct

SEQ ID NO: 414395 - DNA, 5311 bp, Homo sapiens
  misc_feature (108)..(108): n is a, c, g, or t
  misc_feature (1429)..(1429): n is a, c, g, or t
aacctctgcggatgatgacatggcttcactcgtgtttcattcaacaagcatgtgcagtgaccacagatttggggatcttgaaatgatgtcttctcaaaatagcgaggngagtgagaaagagaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcngagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagctgacatggttagccttgaagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggtgggtggagaagagctcatggaggtaaagctccctagggaagagaactctgacttctttgaaagacttgtcctgggctgacattggagtctggggtgggcctaaagcattggcagtcactgtgttccagaacgttttaggcatggtggctgataagtacacctgtgctgagtctggttttgaatatttagctctttctctccacctcccacccaattattttgatattgccacccaattttaccttatatcagaatttggcagcaccagtttctactcagaaagttaccactcaattatagtagtttaacccatttcctgtttagga

SEQ ID NO: 414396 - DNA, 410 bp, Homo sapiens
caggatctccaagtcaccgcgtactatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaa

SEQ ID NO: 414397 - DNA, 539 bp, Homo sapiens
acatgtaagtgctacgcaagtaacgccttttgacccacagtttgggaccttaggccgcaggcctctcttaatatccaccgctacagtatcacagagttaattacaccagacctgcactaaagggaataatagaaagattggtctttggcagaagagaaatgatcctgcatggcagctttaagatgcgtggaaaagtgaagaccaaagaaaggagaaataagatgagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaaaaaaaaaaaaactctccaggcgct

SEQ ID NO: 414398 - DNA, 706 bp, Homo sapiens
  misc_feature (108)..(108): n is a, c, g, or t
aacctctgcggatgatgacatggcttcactcgtgtttcattcaacaagcatgtgcagtgaccacagatttggggatcttgaaatgatgtcttctcaaaatagcgaggngagtgagaaagagaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagactgacagcagcaatcacagtcacattccacagcctctccagcacccagccagctctccgcgggggcagcagggactggtccacccaacaacagcagccatgtcctcacctcttgctacagcagcaactttatttgatttgatgtatatgaagaaataaaactcagaagtcaattgacttaaacatgga

SEQ ID NO: 414399 - DNA, 478 bp, Homo sapiens
attatttttaagcacaagcgaagattctttgaagtttaatgtattcttgaaactcttattctttagaatgaaacataatttgtgcaatctttttcacatattatgaaagtatacagtggaaatgagctgtttgtttttacctttaacaactgaaagagaactggattctggggttactatcagaaacaacgttgggggtgggagtccacatcaaggagaacgtgacagaagaaaccagttctgatgtgtagacttggtttgactcattctgatttttaggacgaggtcccggttactctgggccctttggcaggctttgcttcttgcttaaggccacccaaggaatctgcacctgccttggcctgtcatggagatggcaagtccacagtggacaaatgggctcctggcagcctttggatggaggcaggggctggagtgctctttgtgagggggcttagtcccatgtcacctagccctg

SEQ ID NO: 414400 - DNA, 392 bp, Homo sapiens
ttgaatagttaaatttttattaagataaacatgtgattgtcacacttgatttaatacattagactttgattttgctctattcttagagcgctcgatgtagagcaaagctttagaatgatttttttttcaccttaagtagggtcacgtctttcctttgaatattttccccaacaatttcacaggagtttcttttgccgtcaatcctcaaaacggttttagtcttggcttttcagttcagagggagtggtaatacccctttcctttacttggtcacaattcactatagagttatcgcctgctgttttgttttgtttctcttccagagtgaaagaattgaaaaaggccaaggaacttgaagacatacagcagcatcccttagcaatgtgacattg

SEQ ID NO: 414401 - DNA, 501 bp, Homo sapiens
tttgtctaacataccttcctttcttgctgtgattgctttcttctactagtttaatttaaattgtatttatttattttacttgctctagagggctctctaccagatctcatgtcagggtttccgttggggaatttgacaaagaaactagggggcaggaacctgaacctctttttgatctttgacaaaaagagaatttctggtcttttatccgagaacttcgggctgctgaaggtgccaccatcctgtgtgaggtggtgacagattcacgatcgtgctggggaactctggctggcggagacctctctggtttggtgaagttacggacggcatttggatgctggtcccgcaaggctggcgaggccacgtgttgactgcttttcttccagaacacaacctcactcttcctcctgctctgccctagataaccagttcaggatgtccatcctggaacgactggagcagatggagaggaggatggccgagatgacggggtcccagcag

SEQ ID NO: 414402 - DNA, 623 bp, Homo sapiens
ttggactagcaaagtctctggatatgttactggtatctgttgaggtagtcacacaaaactgaaatactccaacagaaagacttcagaagactttcattttggtgtaaaaacagtgaaattagctgtttgacttaaaatataggagttgtaagacatttcatcgatgctacttctgttttatcctctgtgaaatgtagatactgtgtgtctcccacttgctttttagggttgttgggaggataaatgaaactgtatgacagacacactgggaactcagaagaaaggtgctgttgaaactgaacctcatcctatggctgtgccgttggcaggcataaccggtgtgctgagaggcagtggtagtgaaccccgtggtgaaaggccaggaccatgggctctggagccaggctgccttggttcgaatcccacctcgacctcttgcaagtggtctgaccacagcaaatcacccaacctctctgtgcctgagtttccccctctttaaattggggatgataatagtacccactaaaggatcctggtgagttttagctgagcacatgtccacaaagtccttagagcagtgcctgccatgtagtgtggctgatcctcacacccagaaaacccca

SEQ ID NO: 414403 - DNA, 631 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaaaaaaaaaaaaactctccaggcgct

SEQ ID NO: 414404 - DNA, 505 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaa

SEQ ID NO: 414405 - DNA, 882 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataactcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattgataccagctgtctgagagatctagttggctgacaaatgagtgccgatcaatctctcactagacacgaata

SEQ ID NO: 414406 - DNA, 3193 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagatgatcatgggaacagcaatagtagtcatgtaaaaatctttttaccgaaaaagctgcttgaatgtctgccgaaatgttcaagtttaccaaaagagaggcaccgctggaacactaatgagggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414407 - DNA, 3260 bp, Homo sapiens
  misc_feature (108)..(108): n is a, c, g, or t
aacctctgcggatgatgacatggcttcactcgtgtttcattcaacaagcatgtgcagtgaccacagatttggggatcttgaaatgatgtcttctcaaaatagcgaggngagtgagaaagagaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414408 - DNA, 4016 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttggtatgtattctgaaaatctgatcacagtaagcatttgagaagaacagtctggattcgggttagcttgtcctccagcattattttttaaatgaggaaacctgaactatttccaacaacagcctgacccctagtggcaacagattcagaagataactgtgtttttctcaagctattgtactcgactgccttcattctgagtcactgattgctaagtaggactgttcatggacgtgggatcttctaaaatcaagaattagttctcattccagctctgatgcatactttacttcatgaaaccttaggcgagatttcccacctttcttactagtatcgaatgcatgtttgacagtaatagatgaaaatagtataaatgttcctcaaaacttaaaaaatagtatttttaatgtgaatattctgttccttggatctttgtcaagagctgtgtgtgaactgaacacattgcaggcaagtccattcactcacaatattatgatgtgccagcaataaggactttgtcttatctcattggtaccctacgtgcctagtatggtcgcatgtcttaaatggcaaggctggtacagtatggtattcatgtaaattatatgctattcatcttccgcgaattttacacacgtcacaaaacttgcctgtgatgtgtgggtgtgcgctgtgcacatgtccaagggagatagaggagatagtttgttctttgaaccacaccatgtgcgttaagaatcttctgctctctaattacacctgtggtggttgcatgggtgttctcggggtgacagcagtcaagtgtttcactcaggaagaaagctgtggaagcataggtagctggggtgctctctccctcacacaggtggagagaggattgttgatcttttattaatatctctcgttcattccagggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414409 - DNA, 3966 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaactgctcaggagcgcctaataccacttggtatgtattctgaaaatctgatcacagtaagcatttgagaagaacagtctggattcgggttagcttgtcctccagcattattttttaaatgaggaaacctgaactatttccaacaacagcctgacccctagtggcaacagattcagaagataactgtgtttttctcaagctattgtactcgactgccttcattctgagtcactgattgctaagtaggactgttcatggacgtgggatcttctaaaatcaagaattagttctcattccagctctgatgcatactttacttcatgaaaccttaggcgagatttcccacctttcttactagtatcgaatgcatgtttgacagtaatagatgaaaatagtataaatgttcctcaaaacttaaaaaatagtatttttaatgtgaatattctgttccttggatctttgtcaagagctgtgtgtgaactgaacacattgcaggcaagtccattcactcacaatattatgatgtgccagcaataaggactttgtcttatctcattggtaccctacgtgcctagtatggtcgcatgtcttaaatggcaaggctggtacagtatggtattcatgtaaattatatgctattcatcttccgcgaattttacacacgtcacaaaacttgcctgtgatgtgtgggtgtgcgctgtgcacatgtccaagggagatagaggagatagtttgttctttgaaccacaccatgtgcgttaagaatcttctgctctctaattacacctgtggtggttgcatgggtgttctcggggtgacagcagtcaagtgtttcactcaggaagaaagctgtggaagcataggtagctggggtgctctctccctcacacaggtggagagaggattgttgatcttttattaatatctctcgttcattccagggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414410 - DNA, 3051 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgacctaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414411 - DNA, 3051 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtccccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414412 - DNA, 3051 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgata

SEQ ID NO: 414413 - DNA, 3661 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgataaaaaaaaaaaaacaaaaaaacaaaacaaaaaaaaaaaacaaaacacaacaaaaaaaaaacaacaaaaaaaacacacaacaacagcagacggggggggcaacacgcaacaacagagaagagacgaaacaaaacaaataaagatgaacagcagaatacaagagagacaacagaaagtaagaacataaaacagagacgacagaaagcaatagtaagcagcagcagcagagagacaacacgatgacgcagcagacagataaggagagagaaacatatagagagtatagtcagacacgagacacaccagaagagacgacgaagagaagagacacgagcagagagaaagacagagacagagctagacgaagagagagaacagcgagacaagaaatcatcactggagcatagagcgaaagagaaggagaaaacacgaacagagaaaacagacagaaaagagagaagagaaagagaagaagaaacaaaaaacacaaagagaaaagagaagagaagaaacaagaaaagacacaacagagacagaagaggagaagaaaaagacaat

SEQ ID NO: 414414 - DNA, 8053 bp, Homo sapiens
  misc_feature (1432)..(1432): n is a, c, g, or t
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcngagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagccccctggtggaccataggctgtacaaaaggagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggagccaaagaaatctgatgtttttaacaattaaactgctaatgttaaattgagagaataaagttcgtatttgctgatgccagtttaaaattcccaggttacgtctgaggatcagttggtgtaaagctgagatgttttttcttggttctggctgccaactgtgagttaaaactcaaggcttgttgtgaagcctaaaaatattcacaaataagcttttaaactggtgtctttggaaggaaggtagatacaaaaagattgtgggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccatttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcgaggcaaaaatgcacttccactgaaacgaagcatttctgaccgctttttcttggttatgaatcttaatttcgaatataagatgataggtaagcgcagctttcttggataatctgaattcccaagtgccaggagtaggatttcattataaaattaatagctaatcttattctatctcctgaagatttaattgctattgttacccattcgaaatcagctgtactgtgtgaacgaaataaagacaataatacgaacccctctctggctgcacggtcgcttatggcagttccacacagtagttggcgcccaatggggggtccctgagacttgcatgtaaaactagtctagatgtcttctttttttgtaagttttatttttgtaattgtgcatgtaaagcatcattgaatcaatggatctgttgaagaactcagctgctggaaaccatgcaaaatgttttgaattgcccttaaaatatggaaaatgttttctgaatgctttatattctttctgctgtaaattaaaaatgaagaaaatttccccata

SEQ ID NO: 414415 - DNA, 8286 bp, Homo sapiens
  misc_feature (108)..(108): n is a, c, g, or t
  misc_feature (1429)..(1429): n is a, c, g, or t
aacctctgcggatgatgacatggcttcactcgtgtttcattcaacaagcatgtgcagtgaccacagatttggggatcttgaaatgatgtcttctcaaaatagcgaggngagtgagaaagagaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcngagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggagccaaagaaatctgatgtttttaacaattaaactgctaatgttaaattgagagaataaagttcgtatttgctgatgccagtttaaaattcccaggttacgtctgaggatcagttggtgtaaagctgagatgttttttcttggttctggctgccaactgtgagttaaaactcaaggcttgttgtgaagcctaaaaatattcacaaataagcttttaaactggtgtctttggaaggaaggtagatacaaaaagattgtgggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgctttaaccctcacattttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcgaggcaaaaatgcacttccactgaaacgaagcatttctgaccgctttttcttggttatgaatcttaatttcgaatataagatgataggtaagcgcagctttcttggataatctgaattcccaagtgccaggagtaggatttcattataaaattaatagctaatcttattctatctcctgaagatttaattgctattgttacccattcgaaatcagctgtactgtgtgaacgaaataaagacaataatacgaacccctctctggctgcacggtcgcttatggcagttccacacagtagttggcgcccaatggggggtccctgagacttgcatgtaaaactagtctagatgtcttctttttttgtaagttttatttttgtaattgtgcatgtaaagcatcattgaatcaatggatctgttgaagaactcagctgctggaaaccatgcaaaatgttttgaattgcccttaaaatatggaaaatgttttctgaatgctttatattctttctgctgtaaattaaaaatgaagaaaatttccccata

SEQ ID NO: 414416 - DNA, 2334 bp, Homo sapiens
cgcggcgacggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttggtatgtattctgaaaatctgatcacagtaagcatttgagaagaacagtctggattcgggttagcttgtcctccagcattattttttaaatgaggaaacctgaactatttccaacaacagcctgacccctagtggcaacagattcagaagataactgtgtttttctcaagctattgtactcgactgccttcattctgagtcactgattgctaagtaggactgttcatggacgtgggatcttctaaaatcaagaattagttctcattccagctctgatgcatactttacttcatgaaaccttaggcgagatttcccacctttcttactagtatcgaatgcatgtttgacagtaatagatgaaaatagtataaatgttcctcaaaacttaaaaaatagtatttttaatgtgaatattctgttccttggatctttgtcaagagctgtgtgtgaactgaacacattgcaggcaagtccattcactcacaatattatgatgtgccagcaataaggactttgtcttatctcattggtaccctacgtgcctagtatggtcgcatgtcttaaatggcaaggctggtacagtatggtattcatgtaaattatatgctattcatcttccgcgaattttacacacgtcacaaaacttgcctgtgatgtgtgggtgtgcgctgtgcacatgtccaagggagatagaggagatagtttgttctttgaaccacaccatgtgcgttaagaatcttctgctctctaattacacctgtggtggttgcatgggtgttctcggggtgacagcagtcaagtgtttcactcaggaagaaagctgtggaagcataggtagctggggtgctctctccctcacacaggtggagagaggattgttgatcttttattaatatctctcgttcattccagggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcgttctagatcgcgggcggcc

SEQ ID NO: 414417 - DNA, 574 bp, Homo sapiens
cgcggggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtgtaccaactcatttccagatgtagccactcccctgcctgtacagaagaaactgaatctttttcacattctaataaatcaatgtgagtttttattag

SEQ ID NO: 414418 - DNA, 697 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 414419 - DNA, 756 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctgaaaaaaaaagccgcgaattcggctccttggccattccccttagggggcgattactactg

SEQ ID NO: 414420 - DNA, 664 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatcaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 414421 - DNA, 929 bp, Homo sapiens
ttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 414422 - DNA, 923 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctgggctttgagccgatcctgcataatgttgataatttcttgtcgactttgtagtccctcttccactgcatttcggcttcatacatgcacatgatgtcctcctccttgcactcagtgatgtctggcacgcggcggtactgccggtggtagtagtaatacctgttctttgcgtgctgccgctctataaattctctcacgaggtcgacgcggccgcgaatttagtagtagt

SEQ ID NO: 414423 - DNA, 780 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggtaggcccccaggtcctgatagcggtcctggtaggccttggccacctgggtgaactgctccacttccttgatacagttctgctggtagttctgtccttccctctgctgacaggctttgagccgatcctgcataatgttgataatttcttgtcgactttgtagtccctcttccactgcatttcggcttcatacatgcacatgatgtcctcctccttgcactcagtgatgtctggcacgcggcggtactgccggtggtagtagtaatacctgttctttgcgtgctgccgctctataaattctctcacgaggtcgacgcggccgcgaatttagtagtagt

SEQ ID NO: 414424 - DNA, 857 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctgtgcgtgccccacccacccccaaccccccaccatcctcctgaggcctgggggccagaaccattgcaaatcttccctcccctcccttgtgctcacttgactttgccccctttgcatgtagcagaggcctcggttcccagcttgtttccattgcttccccagatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 414425 - DNA, 284 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagaggtacgaagccccagcccggggctccctcgccggcctctggggacc

SEQ ID NO: 414426 - DNA, 755 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctgaaacacaaaaaaatcactcaacaaaaacaaacatacaccaacatccaacacaaaaggg

SEQ ID NO: 414427 - DNA, 912 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaagacagtcatacagagccacacagcaggggcacccacagctgcctcaggaggtggcagcggcggcctcttttgcagcttttctctcttgcagcatcctctgcctctgtttggccaggcacttcctggcagaactgtaggcccccaggtcctgatagcggtcctggtaggccttggccacctgggtgaactgctccacttccttgatacagttctgctggtagttctgtccttccctctgctgacaggctttgagccgatcctgcataatgttgataatttcttgtcgactttgtagtccctcttccactgcatttcggcttcatacatgcacatgatgtcctcctccttgcactcagtgatgtctggcacgcggcggtactgccggtggtagtagtaatacctgttctttgcgtgctgccgctctataaattctctcacgaggtcgacgcggccgcgaatttagtagtagt

SEQ ID NO: 414428 - DNA, 620 bp, Homo sapiens
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaagcctgggggccagaaccattgcaaatcttccctcccctcccttgtgctcacttgactttgccccctttgcatgtagcagaggcctcggttcccagcttgtttccattgcttccccagatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 414429 - DNA, 3158 bp, Homo sapiens
ccaaagctagtgccatacagcggaaaggcagggcagggcgatgtagacctggaatttgttttcgtctgttcagtagactccgattccagaatatgttggaatttcagactccggaacttttgagaatgccattacaggaactttgcttacataccaagctgttagccccagttaattgtcccattgctgattttcttatgaaagctcctgaacctccaccagctttaattgtaagaaatgctgtacaaatgcttaagacaatagatgcaatggatacatgggaagatctgactgaacttgggtatcatttggctgacttgccagtagaaccacatcttggtaaaatggtcttgtgtgctgttgttttaaagtgtctggaccccatccttacagttgcttgcacgctagcttatcgagatccttttgtactacctactcaggcctctcaaaaacgtgcagctatgctttgtaggaaacgttttactgcaggagctttcagtgaccatatggcacttctcagagcattccaggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatacttattaaaatgaaattctattaaaaaaaaaa

SEQ ID NO: 414430 - DNA, 2425 bp, Homo sapiens
attttaataattttcaagataagaagatatagttgcttaagagagttccttggaaaaaaacccaacatcgaatatgctaggtttcacagtaaacctttggaagttccagctgagtgcttttgctgaatctctatgaaaaacaaaatccattatttttaggtagaaacagttccaggactccatgggaatctgttgccattttgtcacaaaagttgagagattttgcagattaactgtaatcttaaatctggaagtcaactccataaaccttaaagcaaagaattagaacaattcataccagatgattttagcatacgctggtaggaaaatgaaatttaaagtgattttcttacatttttatcagtgtaggttttggtcattaaaaattttcactccagttctttttatgtttattttgacttctgatttatctaggaactagaacctcaggttggtgaacagttgctccagttatgggaacgtcttcccttgggagaaaaaaacacaactgattgacactcaggttataccatcttgactttgagtattggcagtatttgtgatcattaggaacctttcagattatttatctttttttttcccctttcttctagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414431 - DNA, 2503 bp, Homo sapiens
  misc_feature (6)..(6): n is a, c, g, or t
  misc_feature (23)..(26): n is a, c, g, or t
  misc_feature (38)..(38): n is a, c, g, or t
ccctangcggactgactctcttnnnnaccaccgctacngagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414432 - DNA, 3854 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggacctctgaaatctacagacagcagtagttacccaagtccttgtgctagtccttctcctccatcctcaggaaagaccaaacatgcctgttcgatacttcataatgaagagtagcaatttgagaaaccttgaaatttctcaacagaagggtatctggtctacaactctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414433 - DNA, 3849 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414434 - DNA, 2368 bp, Homo sapiens
attttaataattttcaagataagaagatatagttgcttaagagagttccttggaaaaaaacccaacatcgaatatgctaggtttcacagtaaacctttggaagttccagctgagtgcttttgctgaatctctatgaaaaacaaaatccattatttttaggtagaaacagttccaggactccatgggaatctgttgccattttgtcacaaaagttgagagattttgcagattaactgtaatcttaaatctggaagtcaactccataaaccttaaagcaaagaattagaacaattcataccagatgattttagcatacgctggtaggaaaatgaaatttaaagtgattttcttacatttttatcagtgtaggttttggtcattaaaaattttcactccagttctttttatgtttattttgacttctgatttatctaggaactagaacctcaggttggtgaacagttgctccagttatgggaacgtcttcccttgggagatatttgtgatcattaggaacctttcagattatttatctttttttttcccctttcttctagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414435 - DNA, 3867 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaatttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414436 - DNA, 3651 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414437 - DNA, 2777 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaatcgatgcgacaagcaagcgcttccactacgcagcccactcacccaccaccccaaa

SEQ ID NO: 414438 - DNA, 2774 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaatcagatgtcgcccgaaactttttgtttgttttgtaatttataatataagata

SEQ ID NO: 414439 - DNA, 2043 bp, Homo sapiens
  misc_feature (469)..(471): n is a, c, g, or t
  misc_feature (473)..(473): n is a, c, g, or t
  misc_feature (752)..(752): n is a, c, g, or t
  misc_feature (754)..(755): n is a, c, g, or t
tattccttcctcccattttacctacagggattttctaggatgtcttctgagattggaagggaaaagagtcaggactggggctctgctggactaggaggagtatttaaggtggagtgaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaagcgttaaannncnaaaaaaaaccccccaacccccccttttttataagactctttttaaaaacaaaagttttttttaaaaagggcccttatattttaaatttttgcccctccttttaaaagggtccctttttaaagtttttctcttaaaaaaaacaatttccctccccctctttttaaaaaaaaaagggggggttgaatccccccccaaggggggcccctccaaaaaaccccccgggggtttttcccccaaaggggcccccctttttataaaaaaaataaagtattggtgctnanntaagggggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414440 - DNA, 3911 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414441 - DNA, 2503 bp, Homo sapiens
  misc_feature (12)..(13): n is a, c, g, or t
gcattctggaannactctcttaatctccaccgctacagcagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414442 - DNA, 3945 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagatatttgtgatcattaggaacctttcagattatttatctttttttttcccctttcttctagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414443 - DNA, 2243 bp, Homo sapiens
  misc_feature (12)..(13): n is a, c, g, or t
gcattctggaannactctcttaatctccaccgctacagcagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccactcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaaaaaaaaaa

SEQ ID NO: 414444 - DNA, 3072 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctcaggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtatgtgctaactaagggctattcattctgccatttttaacttgagacacatttaagaataaagttggatgttctttttctgtgattatgaaatgcaataaaatctgaataaaaaaaaaaaaaaaaaaaaaaacaaacacgtgtgtgcgggcacgcgcacatgcagggcccgccagcgaaaagccctctgaaaaacacaatggcagggtgagggcgcgccggggcgcccacagaagcggaaacgggaaacagtgggcacaaaaccggttcccagaggaacaccgggcgcaaggacaaagcgcgggtgggagattcgccacaccaatatagaaaacagcccccgggggggacaacgacgaagaggtttttagaaggaactcccgagaggggacgatgcgacagggcgaaccaaccgggggccatttacaacaggggagggcaaaaggaggcacgagaaag

SEQ ID NO: 414445 - DNA, 2278 bp, Homo sapiens
aattattgcttcagtcttttagttatatatataccaaagcaagagaacctattcacagaggagagctttttatactgcatatagatgatttatagaaatcctactttccattcttaggtagagtccagggttgacatagagattattttttggaggacaagagtggcacgattcttagatataagtgttaagaagtcttagttgaaaacctatacttttgtagagagtaaaattagcagatgcatctgagaaggcaaatatttttacattgttagtcatttaggctacttgacacttagttctctttgcgattttataaactcaatggcttttttagcatttgagtataaattaatgataaatattatttgatcataaagtcttagattttatagaaaattagaataaggcaaattcacctcgaggaattcgtgtagtgatttgtagttacttgttgcctcactaagaagcgattagtaaatgtgtcttgttatgcaattattctctttttataggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggtatacaatggcatttttttttttatttacttttgtttctgtttgttttctgttatccagtgctttaattgaggagaaaatgtaagagtacaaattttatattccatatgcacatgggaaacaggggttcaggtttgtaaaaagatagtaaaaacctacttgtaaatgtgtctgattgctccttgcagtcagagtctcaagatgacaatagtatttaacttctctttggctttaattatgtaaagtaaataacctttttatattct

SEQ ID NO: 414446 - DNA, 1055 bp, Homo sapiens
ggagctctgtgggctcagagacaccctcttctcctgagtgttcctccctccaccatgacatcactatgaaggcaattttatttaccacaacaaatattactatagaattaacaggggcccaacacatggcagggactggaaaatacttgctgaatgagtaaaggacttgtgagtctctggggcagctgaatgagactgtttccatcacaggacccagacggggaggaggaatgccagagaagctgcagactctccggccacggagcctgagtggagcagaggtggcccactgtcagccacaggtcaagtgtcagggtggggacggggcaggctccaccagaaggcgggggcaggctccaccagaaggcggggccagaccacagggcaaggtggagatgagtctgtggcacccccaggaagtttaccagatttgccccagagcttctgaccctttggatctctctgggctgcattcttcagggtcccattgcttctttcttgaaggtggaaggaaatgttcccatcagagccttccaacaggccaccttgggggcttctcctgagagctccttgtgcacacaccccttcagggtggcttgggttgcgccctcagaccccagtggggggccgtatggcatcctccttggtcagcaagtgagccacagcagcaggcccctcacagacctcagcctggggccacaggtcccttctccccatctccgcatctggagaagcaacctgtggagcagccaagagtggcagccctggctctctacagcattcattttcagggcaagacagagcatttccactattatgctcccccccccggccttttttttttttttttgagacagggtctcactctgttgcccaggctggagtgcggtggcgcaatcatggctcactgcagcctcgaccttctggggtcaagtgatcctcccaattcagcctccaaatttctttaaacaaaaaaaaatgcaagaaaggcaaaacaagatatttatctgggctgagagggtaaagagaagctctatctttgagctgagacacaa

SEQ ID NO: 414447 - DNA, 219 bp, Homo sapiens
aacagactgcgagtagacaggctggttttagaggaaggagttgttttaccaagtgctgttctctgcaagtgatcccctaatgaagccaatcacaaacaaatttctcctgaaattctactttacagtcattagcagtgaattgaaaagctggttttcagtaagaattcacttgggaattaagtgctcatcaaggccagctgcaggcttaatcatgcagaa

SEQ ID NO: 414448 - DNA, 894 bp, Homo sapiens
ttaaactgttgaaaaacaaagaagagaaccttaaaagcagcaagagaaaaatgactctttatgtacaaaaaatcctaaggaaaattaacagctttctcatcagaagccatgaaggccaaaaggcaggtaaatgacatattcaaagagctaaaagaaaaagactgtaagaattctatatctagcaaatctattcttcaaaaatgaaagagtggaagagaagtagtagtaaaaccatctatatgcagacaacttgaccgtgtatatagaaaatcctaagggatccactaaaaaactcttggaactaagttcagcaagcttgttggaaacaacatcaccagtacacaaaaatcatttgtattctatagatttttaatgaacactctgaaaatgaacttaagaaaacaattccattttaaatagcatcaaaaaacacttatgagtacatttaacaaaagtagctaaaacttatactctaaaaatacaaaaaacattgttgaaagaaattaaagaagacctaagtaaataggaagacatcccatgttcatagattagatcttaatattgttagatggcaatactcccaaaattagtgtatcaattcagtgtaattttcttttttgagacatgaacttgctctaatattcaggctggagtgcagtggtatgatcatggctcgctgcaacctcaaactcctgggctcaagcagccctcctgcctcagtctcccaagcaactgggactataggcatgtgatgccacatctggctaatttcagtgcaatctgtatcaaaagtccaattggcttctctgcagaaatggacaggctgatcataatattcacatagaaattcaagggactctgaatgaccaacaatcatgaaagacaaaaaaaaaa

SEQ ID NO: 414449 - DNA, 725 bp, Homo sapiens
caaagagtgggagactttgtgttccaaagtgtttaaggaaattcctgtccagttgttagctgactactaagttaaatgagcattgactttagtggacacacaaatcagggaatacaaactttatagaataggagaaaatattttcaaatcatttatctgataagacagttacatctagaacatacgaaaagctcctccaactcaacaataaaaagacaacctaattttaaaacaggcaaatgatttgaatagacatttctccaaagaagatgtacagatgggcaaataagcacatgaaaagatgctcaacatcattactcattaggaaatgcaaatcaaaaccataacaggtgcagtggttcccacttacagtcccagctacatgggaggccaaggcaggaggattgcttgagcccagtagctcgaggctgtagtgcaatatgattgtgcctatgaacagccactggacaccagcttaggcaacatagcaagatcccatctcttaatttaaaaagaaacacaaaaccataagaagatatcacattctacccaccaggatggctgtaatcaaaaagaccgcacagacaagaatatgcagaaattggaaccctcatagagtaatagtgggaaagtaaagttacagccacagtggaaaaaaagaatttggcagttcctcaaaaagttaaatgtagtcttatcatatgacccggcaattccattccata

SEQ ID NO: 414450 - DNA, 161 bp, Homo sapiens
taatttttgtatttttagtagggacagggaggatacagtcttatgtagaaaaattataaagacatgtatgggaatagcagacgctgttcaaaatgatactgacttctagagaaagagggaggagggggacttcggggtacgccagcatcttgaattgtatt

SEQ ID NO: 414451 - DNA, 514 bp, Homo sapiens
gcccccagggactactccaactacattaaaaaattaggttggcatcaaatgacttattgaactctgtattgatatccttgggatttggttgtcaatctacacagtagttagtctcctttcacagcgaccgcattaagtaggaagttgtaacagttattgacgatttgagcaaattattttcctctatccagcccctacatacaacaacaatagtaataaacacagcttgagtgaaaagtatattccacatatggcatggatgctttgtttacatggtacgtggttttatttcacaataactcctaggtagatattatgtcctttctgagatttaagcattactttagtcacttaatcaaaaatcataaactgaagctcatgccattgaccccagttatataaaagaagtttgaaattttcttttgatctaggttttgcaccctgatagacttcacagataatgtaactaattagtaactgtgttttatttttgtgtacccatattctccttgcc

SEQ ID NO: 414452 - DNA, 371 bp, Homo sapiens
ggctccaggtgatccagcccctgtggcttctctgagctcatcccctaaaactaccctctccgtcactctactcacacgggggcttctgattctgcctcaaacgtggcaggcatccccactcctcagactattggcgtcccacgctccttctccttggaacgctgctctctcagattggcccatgacttgcctatttgcctctttcaagtctttattccaattcaagtttctcagcgaggttctctctcaccacccaatttagaggtcactccccatctctttctgtggtgtatgtgtatggtatgtatccctaatatagataagttatacaaagtctcagcatttatctttttttttttttttgagatgga

SEQ ID NO: 414453 - DNA, 2754 bp, Homo sapiens
taaaataaaataaaataaaaataaaagtttgcagtttacacaatcaatcctggaagcattttatttacactgtgggtcccactgctgagctaacttgcatttacaaagcacctctagatactgtcataatgtatccagaaattcaattagagagagtgtgtgtttctgggccaacagaggcaaggttagggggcagaggtaatataagtgagctggcccaagccatgcaacttagcctcatagattgaagtcatcacatgaattaaccccaaactggtacccagtgatgtcagagcatgagtccagatgtgctctgtgcgtgcatgggatggcttccaataaagtcaaatgacacagtcacgtgtcagtttaggtcctctaggaaacagacaccagagagaatgagaagtgcaagtgacatattgggggatgcctatgaaagacaaaggggagagggagcaggatgaggtgggaaggcttcagactgtgacacaggtgtgccacctgtgaaaagtgaaggggaaagaagcagcattctcagggagagcctcagaccacagtgccactctgagcaagtggccaggctgatggagcctgacactaaaggttgcccattagagaagtctcggccctagtgtcccagccacatggagtgtcccagagagcgcagctttggtgtgagctctgagggagcaagtcctctttgaggttctctgaaagaagatctaagctgtgcacttcttgggctgccttaattatgcttcaagggtcagaagggtccaactcttgtttgaaccgagactcaatcccagcctgcaaatgactttccctgattgattacaacttgctttaaaagtccagagacttttatctcttaatgaaagatatttaaatgagggtgatttattactttgaggtcgcggtgatcacgaaagtatgactgagtatatgtgattgatatgggccataatgcttcattcattcacaattcagcagaccaaattaaagagatgcgtgtttaagtttcaatcctgccatgactgtgatcttgggcaagtcacttctctctcagcttcagctccctcatgtccaaaataagtgggttgcactaaatgagatccagcatcctccagttcaattattctgtcattctccttccttcgagcttgactctgatgaggccgggaataaaaatgaatgatttctcacttgaattttcgatgcactgtgaaacatagttaatcttcctcttctctatttcagtgactgtcacaaagatcaagctagattttccaaagcttacctcttagactcaactcagctaattatcagctgatttggcagatcactgtaggaatcactaaaataactccttatgcaactttaaaaatctagcatagcattttaaatattatatgagatgttatagcttcataaatttcctattccatttactttcatcatacttgaaatcagatcactgaaaaacctatgcaaaacatattctaagtgctattttttggtgggtacagattcacaatgtcactttgtttgcatatcatattttattattattagagcaatggctttatctgaaacatgaaagataaacttttttggtgtgagccaccatgcccagccagttgtaaattttttaatatccaagttttttaaaagtcacaaataattcaatattttttgagcacccactctgtagcagacatgtcctggaagctaaggaaataaagcctcagaggggcattaggcgtcttttttatgccgggcactgtgctggcactgagaacacagcatgagcaaagttgaggtctctccctccctcccctccctcaaggagcctgtttgaacatcgagattcttaaccagaggtacacatcagaatcaccaaggtagcttcatcatagtacagatgccagcccccgcactgagagattctttcccagtaatgggtggggtcatcagtatttgagaaacctgccatgatgattctaaggctaaaacatggttttttaagataaggactgacccctattctctgaaaattgcaaaataggtacctcttctggacttctcatggagggggctgtatcaatagaatataaattcgtagaaagagaaaggtgttcataattgaatttttaaaaaaagaaagaagaataaggaagacaatactatactgaggggaaaaaaaagggatgggtagagccatgtgaataagcctctgcatgcaaagttatacgctttatcaaacaactctctagctgtgttttgtaaatatgtaaaaaggttgatcatctctgataggagagacttttagtgaatttcagataccctagaggaatggatactggagggggctagctctgtgccaagactccagggtgggttttactaacatttctttctactcctttcccaaggcagataaaagggtagttcctactgtcatcctaaatgtcccactgggattttaaaaaggatcattcaacgcctgtgctgctttacagcccttatcttctaatagaataatggccagtcccccagtggcatatagaccagaataagttcaagttaatggctacaaacaagcagggcagtgctagagctaagctcaggggctcactacctgcttcctgtacattggagagaaaagccatatacaggccgcaagaatgcaaagacacagggaagagaacggccacctcaagacagatcaataaaacagcacaggaaaga

SEQ ID NO: 414454 - DNA, 2152 bp, Homo sapiens
  misc_feature (1816)..(1816): n is a, c, g, or t
taaaataaaataaaataaaaataaaagtttgcagtttacacaatcaatcctggaagcattttatttacactgtgggtcccactgctgagctaacttgcatttacaaagcacctctagatactgtcataatgtatccagaaattcaattagagagagtgtgtgtttctgggccaacagaggcaaggttagggggcagaggtaatataagtgagctggcccaagccatgcaacttagcctcatagattgaagtcatcacatgaattaaccccaaactggtacccagtgatgtcagagcatgagtccagatgtgctctgtgcgtgcatgggatggcttccaataaagtcaaatgacacagtcacgtgtcagtttaggtcctctaggaaacagacaccagagagaatgagaagtgcaagtgacatattgggggatgcctatgaaagacaaaggggagagggagcaggatgaggtgggaaggcttcagactgtgacacaggtgtgccacctgtgaaaagtgaaggggaaagaagcagcattctcagggagagcctcagaccacagtgccactctgagcaagtggccaggctgatggagcctgacactaaaggttgcccattagagaagtctcggccctagtgtcccagccacatggagtgtcccagagagcgcagctttggtgtgagctctgagggagcaagtcctctttgaggttctctgaaagaagatctaagctgtgcacttcttgggctgccttaattatgcttcaagggtcagaagggtccaactcttgtttgaaccgagactcaatcccagcctgcaaatgactttccctgattgattacaacttgctttaaaagtccagagacttttatctcttaatgaaagatatttaaatgagggtgatttattactttgaggtcgcggtgatcacgaaagtatgactgagtatatgtgattgatatgggccataatgcttcattcattcacaattcagcagaccaaattaaagagatgcgtgtttaagtttcaatcctgccatgactgtgatcttgggcaagtcacttctctctcagcttcagctccctcatgtccaaaataagtgggttgcactaaatgagatccagcatcctccagttcaattattctgtcattctccttccttcgagcttgactctgatgaggccgggaataaaaatgaatgatttctcacttgaattttcgatgcactgtgaaacatagttaatcttcctcttctctatttcagtgactgtcacaaagatcaagctagattttccaaagcttacctcttagactcaactcagctaattatcagctgatttggcagatcactgtaggaatcactaaaataactccttatgcaactttaaaaatctagcatagcattttaaatattatatgagatgttatagcttcataaatttcctattccatttactttcatcatacttgaaatcagatcactgaaaaacctatgcaaaacatattctaagtgctattttttggtgggtacagattcacaatgtcactttgtttgcatatcatattttattattattagagcaatggctttatctgaaacatgaaagataaacttttttggctgggtgcagtggctcacgcctgtaatcccagcactttgggaggccgaggtggatggatcacgaggtcaggagatcgaaaccatcctggctaacacggtgaaacctcgtctctactaaaaatacaaaaaaattagccgggcatggtggcgggcacctgtagtcccagctactcgggaggctgaggcaggagaatgntgggagtgagcttgcagtgagccgagattgcaccactgcactccagcctgggcaacagagtgagactccgtctcaaaaaaaaaaaaagataaacttttttgaatacaaataccatatcattccattccactgcatttatatcagggcaagggcacatggagagtcaacatagaaatactgtaaaggaccatcagtgtggatggtttcagtcactagattgtaccaggtcggggaggaaccacatgttcctctaataccctctgcagccctgagaccctcttctccatttaggcctcacacaatttaagttggtaatggagccaggaatagaattcc

SEQ ID NO: 414455 - DNA, 2990 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggcaaaaaaaaatgaaagcagacacacaaacaacaaaaaaaaacaacagaaaacagggggcgggccgccgtcaagaataccaccacacaggggcacacagactaacgccttccccgaaggtctacggcacaagtgggcccccagagcgacacctacaaaacag

SEQ ID NO: 414456 - DNA, 2507 bp, Homo sapiens
gcacgagagagagagagagagagagagagagagagagagagagagagagagagagagtgttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggc

SEQ ID NO: 414457 - DNA, 2728 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggc

SEQ ID NO: 414458 - DNA, 2775 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagtcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggc

SEQ ID NO: 414459 - DNA, 2334 bp, Homo sapiens
ttcaggctggactcgccacctggatccggcgtaaggcatcaaacacagttcctgtaccaggggtggagccaaacttggaggctttgaaacgagcggatgatatcgttgcaaggttgcggccaccacaaagtattcctgcttcaatctttagactccttcccttcaaaaaaattgtcattgggatagaggacccgggcagatgttctcgggcaggtttcggtccagcacagactgaatgtaggtctccaataccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggc

SEQ ID NO: 414460 - DNA, 1662 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtgtgagcctccattactctggcagtgggtctgacactgatccattaatggaatgatgctactaaatgcagggttgcacttagggatgaggaaaggccttgttcaaatgtttaaaagtattttcttctatacaaaaaactcttgccta

SEQ ID NO: 414461 - DNA, 1695 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaattcagagtgctcgtatagccagcgttttgtatagtatttagtacagtagataatacattgactatgtagcatatagtggtgatattgagtatagggcatgtcgtgttttgaataatagaatatatttttgtaaataaatctgttacttctcttagcgcagcccagtcattttggagacaaaggagctgaggccaagagaggagtgacttttataagggtcattttgcaaccagctttgtcagaaaattgtcagttcttttttttttttttttttttttgccagaaaattgtcagttctatagtaaccagcatgcttacctctttggttttatattaaggtgttgatagcaaaattgaataatttgaaatgtcattcctggctgggtgcagtggctcacaactgtaatcccagcactttgggaagccgaagcgggcagatcacctgaggtcaggagttcaagaccagcctggccaacatggtgaatccctatctgtactaaaaatacgaaaattagccaggagtggtggcccatgcctatagtcccagctacatgggaggctgaggcaggagaatcgcttgaacctaggaggtggaggttgcagtgagctgagatcatgtcgctgcactccagcctgggtaacagagtgagactctgtctcaaaaaaaaaaaaagataaacttttttgaatacaaataccatatcattccattccactgcatttatatcagggcaagggcacatggagagtcaacatagaaatactgtaaaggaccatcagtgtggatggtttcagtcactagattgtaccaggtcggggaggaaccacatgttcctctaataccctctgcagccctgagaccctcttctccatttaggcctcacacaatttaagttggtaatggagccaggaatagaattcc

SEQ ID NO: 414462 - DNA, 542 bp, Homo sapiens
taactgattctgtatattctagccacaagaatcttgactgaaccctttgtgtaggactcaacaggcccaggtatccaacgataaacatccctgtaaggcgtctgtctttagctgaagctggacaattggattcacagacgttaagacagaggctctggaacacagagacctaagggcagatcttatctctatcgtttactgtttgaccttgagatcttatctctaccgtttactatttgaccttgagcagttacaattcctcatctttaaaagaggattaaatgcagtaatacatataaaatatttagagctgtattagcgagtattattgttgatgtaggctgtaaaaaagttacaaaacagtactcagtattcataagttgtttcagttaaagatgttttaaatttaatataatataattgaagtgctaggttcatatttcctgacaaataaattctaagcaatactgtatccttttgcaggtagaagaagcagatgattggctcagatatggaaacccttgggagaagtcccgcccaga

SEQ ID NO: 414463 - DNA, 440 bp, Homo sapiens
agcatagattagcgtgatctgctcaggtagtttaggcttggggaaaaagttagatattctccaccagcgatgccagtaaggtttaagaataacacacacaaatctggttctctttttctccttccactgatattcccaacttccaaatgcatcccagtgatgacattctcacatgtgagaaccataagaaggttgagggctggttaaaagtcttacaaacagaaatatgaatttggtaaaccagccatgcctgatattaagcaaaagatgattttacatggaattttagcatatatctattaatgaagattttgactgtttttttcctcttccactcacaaaataaaaggtttaaagtctttgcagactacgaagcctatgtcaagtgtcaagataaagtgagtcagctgtacatggtgagtaaattgccaagatttata

SEQ ID NO: 414464 - DNA, 383 bp, Homo sapiens
agaccacccaattcttctaggccaaaagagctctggcaccatgcactgtcttaacaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgtgagtcagccctgtagccaacaagcccccttgcaggtggaagcagcagactcagcataggtctcactgccctgaccgtcagctgtcttccatttcatccacttctccatctttttcaggcattaagaaagaccctaagaagttattcgtgccaaggacagttatcattggtggtaaa

SEQ ID NO: 414465 - DNA, 391 bp, Homo sapiens
ttctgatctgaacttcactgactaagcaggcattgtatggaggaagtagggagggcatttttaaagcaattctcatgtgaagtccagcatgacggtgtgttgaaatcctttgggatttttaggaattttaggaatcccacatgacacacagcacagagccagtgagatcaagaggtttccaacaacaatggctggtttctctatttattgtttctctaactttcccctagttaatgttggagactacattcaggctgtgctggaccgaaacctggccgagaacatctcccgggtcctctatcccaatgacaatgtgagttgatcaaaggtgctttcttagtggcaacagaggcagcttatttcacaagagcctgttcagtaacctataaaa

SEQ ID NO: 414466 - DNA, 377 bp, Homo sapiens
ggtagttagaaccaaattgagcttgaaacaaacaaaaaagccttgagtttctgatctgaacttcactgactaagcaggcattgtatggaggaagtagggagggcatttttaaagcaattctcatgtgaagtccagcatgacggtgtgttgaaatcctttgggatttttaggaattttaggaatcccacatgacacacagcacagagccagtgagatcaagaggtttccaacaacaatggctggtttctctatttattgtttctctaactttcccctagttaatgttggagactacattcaggctgtgctggaccgaaacctggccgagaacatctcccgggtcctctatcccaatgacaatgtgagttgatcaaagg

SEQ ID NO: 414467 - DNA, 2830 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggc

SEQ ID NO: 414468 - DNA, 2851 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggcaaaaaaaaaaattaacgtttt

SEQ ID NO: 414469 - DNA, 2784 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatgggtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggc

SEQ ID NO: 414470 - DNA, 2633 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatggtgagtaaattgccaagatttataaagaaaaccagtttactatgattcattaaaatgtgggttttttaattaaatgcaaatatcagatccccatgtaatatcagatccccattaagcaatcaaaaaaaaaacaacaaaaac

SEQ ID NO: 414471 - DNA, 2365 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagcgccagtcgacgcggccgcgaatttagtagtagtaggc

SEQ ID NO: 414472 - DNA, 1575 bp, Homo sapiens
actgaaagtgtagtatatatgtcagtgtgaagaagtcagatggaagtgactagatttggaatttttctggtaattcttttgagttgcaaatgaatttctatttaaatgacagccatagctactgtcagcctgtccctccacctttatttaacctttctaagcctgcacttggcttcttgaatataactccgaactttgtccagtgtgcaggaccctttgccgtttcagccaaattcagtgatgtgtctcctccatctccagattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggc

SEQ ID NO: 414473 - DNA, 1238 bp, Homo sapiens
ctcaaaaaaaagaaaaaccagaccacccaattcttctaggcctcagttcctggagacggagtacaaagtgaagatcaacccatcctccatgtttgatgtccaggtgaagaggatacatgagtacaagcgacagctcttgaactgtctgcatgtgatcacgatgtacaaccgtgagtcagccctgtagccaacaagcccccttgcaggtggaagcagcagactcagcataggtctcactgccctgaccgtcagctgtcttccatttcatccacttctccatctttttcaggcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggc

SEQ ID NO: 414474 - DNA, 5648 bp, Homo sapiens
ctctgccaaatccacctcctgaggagatttccacaggaactcaatccacattcagcacaatgggcacagtttccaggagaaggatctgcagaaccaacacaatggcacgagccaagattctccaggacatagacagagagcttgatcttgtggaaagggagtctgcaaaacttcgaaagaaacaagcagagcttgatgaagaagaaaaggagattgatgctaagctacgatacctggaaatgggaattaacaggaggaaagaggccctattaaaggagagagaaaagagagaacgagcctacctccagggagtagctgaggatcgtgattacatgtctgacagtgaagtgagtagcacaagaccaacccgaatagaaagtcagcatggcattgagcgaccaagaactgctccccaaactgaattcagccagtttataccaccacaaacccaaacagaatctcaactagttcctccgacaagtccttacacacaataccagtactcttcccctgctcttcctacccaagcacccacctcatacactcaacagtctcattttgagcaacaaactttgtaccatcagcaagtttcaccttatcagactcagccaacattccaagctgtggcaacaatgtccttcacacctcaagttcaacctacaccaaccccacagccttcttatcagttaccttcacagatgatggtgatacaacagaagccacggcaaactacattatatttggagcccaagataacctcaaactatgaagtgattcgcaaccaaccccttatgatagcacctgtttctacggataacacatttgctgtttcccatcttggtagtaagtacaatagtttagacttgagaataggtttggaggaaagaagtagcatggcaagcagtccaatatcaagcatatctgcagattctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaagcctatcatctgcgtcgtgaggaaacagattggtttgataaacccagggagtctcgtttggaaaatggacatggtctggaccgaaaactgccggaaagattggtccactctagaccactcagtcaacatcaagagcaaattatacagatgaacgggaaaactatgcactacatctttcctcacgcaaggataaaaataacaagagactcaaaggatcacacagtttcaggtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataaattcctcagcatggcagcttaatgttcatctgttgcctttctttcctgctgtcctttcctgtttgctttcagttttcaacatcctctgctcaccctgttctctgtccctttgtctgtgtaagaacgatataaatacattaatatgctctttcttatttagattttttttatttacatagactgaaataaaactggctgtttctcctttgtttccaccatccatccaacctggctcatagcatttgatacagtgtctgtgatgtttggaagcaaagcaatgttgtgtgtcctttttgtttgcgcttaaatatcttttagaatacagaaattataagcacaagtggctgccagttttccaggacttataccaaaaaaaaaaaagtgcacacatataagtatttagagcagatttgcaattagattcttgtatctgaaaacactcaaaaagtctaggcagaagataatgcaaccaacagtcaacttctagaaccttggaggaaaagccatttcaagacagtgctttaaaacactaacaaattttgcttctgaaatatggtagctttccatgtgcaaaaaattgtagtcttctgaaaaatctgtgaagaaaatcttatttcttacattctcaaaaaactacattaaattaatatatgtataagcatatgtgataaggcaatgcaacctcactgaggagcacaattgggtccattctgttggatcacactttgtatgtgatgacagattttacagatattttttctaaccattggaaatcaagatatactatgtctggtagctataagtcaatcaaagtataacaattgacctatcttaactgctgtattttcatttcatttgtgaaaatttagtcgattgatataattatataaaaacttaatatgtgcaaatatttcacaaatgtaggtaccctgttacttctaaaaggcattagccaggcaatggagatagatcattgttctctccatctccctagtcatcattttcaaagaaacagccagttttaaacccctttagtgctgtgcatgtggtgtcattttggcatttgaaaacacaacctatttaaatagagcaaaagagcacttctgtttgcatgaataacatttaagctggttccatctgaggatacatactctgggtttccatttcacccacactgccacagcagcacataaaagcggtcagtctaatcatgccaggaagcagcacagacacagcatagcaggagtcctccccattcaaagaactcagtctgataatctgcctccaccagccaatggcaaccaagaccaaagccagctagccctcaggaaggtgatgtctgatggaccagtcaagccagaaggaggtgagcagaaaggccctgttcaaagcacacagcaagaacatccccaaatttaaagctctcatctttaatttttagagattgtctgataaaatatgtttatccactttttaatgtgcttttgtgggcatggcatttcaggacttcatcatcaccatgtaagtcccaagatcagtcccgtaatatattgactacagtgatttgtatttttctatgcactgggcatcttttgacttttgttgggaaatagattaacaatattcatattgcagaatggaatgcatgctactaacctaatctgttcaagcatgactataaatatgtttcattgtgataaaagtttaaattgctcacagttcaagttagcctaccagttggaatgtggatcagtgttttttgcctattatttcaagtgtaacttttaaaaatttagtggattttgaaaattcttagaggaaagtaaaggaaaaattgttaatgcactcatttacctttacatggtgaaagttctctcttgatcctacaaacagacattttccactcgtgtttccatagttgttaagtgtatcagatgtgttgggcatgtgaatctccaagtgcctgtgtaataaataaagtatctttatttcattcataaaaaaaaa

SEQ ID NO: 414475 - DNA, 3956 bp, Homo sapiens
ccctgtgcagagctagagctttcagtcttagggaagagctagaagaatcccttttaattgataaatcaagcccatagacagaggaaggtctggaggaaggtctggacctgctgccactactgtatggcttatccgcttcatcctgcagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaagcctatcatctgcgtcgtgaggaaacagattggtttgataaacccagggagtctcgtttggaaaatggacatggtctggaccgaaaactgccggaaagattggtccactctagaccactcagtcaacatcaagagcaaattatacagatgaacgggaaaactatgcactacatctttcctcacgcaaggataaaaataacaagagactcaaaggatcacacagtttcaggtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataaattcctcagcatggcagcttaatgttcatctgttgcctttctttcctgctgtcctttcctgtttgctttcagttttcaacatcctctgctcaccctgttctctgtccctttgtctgtgtaagaacgatataaatacattaatatgctctttcttatttagattttttttatttacatagactgaaataaaactggctgtttctcctttgtttccaccatccatccaacctggctcatagcatttgatacagtgtctgtgatgtttggaagcaaagcaatgttgtgtgtcctttttgtttgcgcttaaatatcttttagaatacagaaattataagcacaagtggctgccagttttccaggacttataccaaaaaaaaaaaagtgcacacatataagtatttagagcagatttgcaattagattcttgtatctgaaaacactcaaaaagtctaggcagaagataatgcaaccaacagtcaacttctagaaccttggaggaaaagccatttcaagacagtgctttaaaacactaacaaattttgcttctgaaatatggtagctttccatgtgcaaaaaattgtagtcttctgaaaaatctgtgaagaaaatcttatttcttacattctcaaaaaactacattaaattaatatatgtataagcatatgtgataaggcaatgcaacctcactgaggagcacaattgggtccattctgttggatcacactttgtatgtgatgacagattttacagatattttttctaaccattggaaatcaagatatactatgtctggtagctataagtcaatcaaagtataacaattgacctatcttaactgctgtattttcatttcatttgtgaaaatttagtcgattgatataattatataaaaacttaatatgtgcaaatatttcacaaatgtaggtaccctgttacttctaaaaggcattagccaggcaatggagatagatcattgttctctccatctccctagtcatcattttcaaagaaacagccagttttaaacccctttagtgctgtgcatgtggtgtcattttggcatttgaaaacacaacctatttaaatagagcaaaagagcacttctgtttgcatgaataacatttaagctggttccatctgaggatacatactctgggtttccatttcacccacactgccacagcagcacataaaagcggtcagtctaatcatgccaggaagcagcacagacacagcatagcaggagtcctccccattcaaagaactcagtctgataatctgcctccaccagccaatggcaaccaagaccaaagccagctagccctcaggaaggtgatgtctgatggaccagtcaagccagaaggaggtgagcagaaaggccctgttcaaagcacacagcaagaacatccccaaatttaaagctctcatctttaatttttagagattgtctgataaaatatgtttatccactttttaatgtgcttttgtgggcatggcatttcaggacttcatcatcaccatgtaagtcccaagatcagtcccgtaatatattgactacagtgatttgtatttttctatgcactgggcatcttttgacttttgttgggaaatagattaacaatattcatattgcagaatggaatgcatgctactaacctaatctgttcaagcatgactataaatatgtttcattgtgataaaagtttaaattgctcacagttcaagttagcctaccagttggaatgtggatcagtgttttttgcctattatttcaagtgtaacttttaaaaatttagtggattttgaaaattcttagaggaaagtaaaggaaaaattgttaatgcactcatttacctttacatggtgaaagttctctcttgatcctacaaacagacattttccactcgtgtttccatagttgttaagtgtatcagatgtgttgggcatgtgaatctccaagtgcctgtgtaataaataaagtatctttatttcattcataaaaaaaaa

SEQ ID NO: 414476 - DNA, 3318 bp, Homo sapiens
ctgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataaattcctcagcatggcagcttaatgttcatctgttgcctttctttcctgctgtcctttcctgtttgctttcagttttcaacatcctctgctcaccctgttctctgtccctttgtctgtgtaagaacgatataaatacattaatatgctctttcttatttagattttttttatttacatagactgaaataaaactggctgtttctcctttgtttccaccatccatccaacctggctcatagcatttgatacagtgtctgtgatgtttggaagcaaagcaatgttgtgtgtcctttttgtttgcgcttaaatatcttttagaatacagaaattataagcacaagtggctgccagttttccaggacttataccaaaaaaaaaaaagtgcacacatataagtatttagagcagatttgcaattagattcttgtatctgaaaacactcaaaaagtctaggcagaagataatgcaaccaacagtcaacttctagaaccttggaggaaaagccatttcaagacagtgctttaaaacactaacaaattttgcttctgaaatatggtagctttccatgtgcaaaaaattgtagtcttctgaaaaatctgtgaagaaaatcttatttcttacattctcaaaaaactacattaaattaatatatgtataagcatatgtgataaggcaatgcaacctcactgaggagcacaattgggtccattctgttggatcacactttgtatgtgatgacagattttacagatattttttctaaccattggaaatcaagatatactatgtctggtagctataagtcaatcaaagtataacaattgacctatcttaactgctgtattttcatttcatttgtgaaaatttagtcgattgatataattatataaaaacttaatatgtgcaaatatttcacaaatgtaggtaccctgttacttctaaaaggcattagccaggcaatggagatagatcattgttctctccatctccctagtcatcattttcaaagaaacagccagttttaaacccctttagtgctgtgcatgtggtgtcattttggcatttgaaaacacaacctatttaaatagagcaaaagagcacttctgtttgcatgaataacatttaagctggttccatctgaggatacatactctgggtttccatttcacccacactgccacagcagcacataaaagcggtcagtctaatcatgccaggaagcagcacagacacagcatagcaggagtcctccccattcaaagaactcagtctgataatctgcctccaccagccaatggcaaccaagaccaaagccagctagccctcaggaaggtgatgtctgatggaccagtcaagccagaaggaggtgagcagaaaggccctgttcaaagcacacagcaagaacatccccaaatttaaagctctcatctttaatttttagagattgtctgataaaatatgtttatccactttttaatgtgcttttgtgggcatggcatttcaggacttcatcatcaccatgtaagtcccaagatcagtcccgtaatatattgactacagtgatttgtatttttctatgcactgggcatcttttgacttttgttgggaaatagattaacaatattcatattgcagaatggaatgcatgctactaacctaatctgttcaagcatgactataaatatgtttcattgtgataaaagtttaaattgctcacagttcaagttagcctaccagttggaatgtggatcagtgttttttgcctattatttcaagtgtaacttttaaaaatttagtggattttgaaaattcttagaggaaagtaaaggaaaaattgttaatgcactcatttacctttacatggtgaaagttctctcttgatcctacaaacagacattttccactcgtgtttccatagttgttaagtgtatcagatgtgttgggcatgtgaatctccaagtgcctgtgtaataaataaagtatctttatttcattcataaaaaaaaa

SEQ ID NO: 414477 - DNA, 2860 bp, Homo sapiens
gagacggagtttccctcttgttgcccaggctggaaatggcgcgatctcggctcacagcaacctctgcctcccggatttaagcgattctcctgcttcagcctcccgagtagctgggattacaggcatgcaccaccatgcctggctaattttgtatttctagtagagatggggtttctccatgttggtcaggctggtcttgaactcccgacctcaggtgatccacctgccttggcctcccaaagtgctgggattacaggcgtgacgactgcacctgcagccgcctagtcctcttctccttctctttgatgattcagggcctcggcttccctcacgatattgcagaaagacacagctttcctcttcctctccaaaccacctcgaagcaggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgccttttaaaaaaaaaaaaaaaaaaaaaaaaaaaaaaaaaagaaaaaaaaaaaaaaaaaaaaaaaaaaaaaaaaaaaaaaaaaaaaaaaaaaaaaggaaaaaaaaaaaaaaaagaaaaaaaaaaaagggggggggggcgcacacacacatactccgccaggggggcgcagaaaaagagagcacacaacacgctagtgtatgcaaaaggaggggcaccgcaaaaagggagaccatcacaaacacgccggcacggcggcgctcaacacacatcgccctcgcatgagaggaacgagaattacctggacagaggcagtcatagtgaaggggaaggaacaacacccaccaccgtagccggggggaagaacagaatcaggtagtcggaccgacacgccagcaacgagagggcacaccacccaacagggggcgaacaagaaagaaacgagggcgagaaatgaaggggatgagacaagaaaagcacaccgagtacgggccgggcaaggagatgcgcggccagcagataggagaacaaaacaaacagacggaggagagaaagagaggggg

SEQ ID NO: 414478 - DNA, 2017 bp, Homo sapiens
agcggaaaacccggcctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 414479 - DNA, 2095 bp, Homo sapiens
agagaacgcgctcgcgtagaggaattccgggtcctcctcctcgccctaccttggtttacctgcagccgcctagtcctcttctccttctctttgatgattcagggcctcggcttccctcacgatattgcagaaagacacagctttcctcttcctctccaaaccacctcgaagcaggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 414480 - DNA, 2509 bp, Homo sapiens
agcggaaaacccggcctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgccttttactttgcttggtctatcattttcctaccaaagtttgtcctcttaatatttgttggattcctgttccttcaccccatccccaccctcatcttcccatgcccctgatggagttgcagtgttgcagcccttttttgtttacttttcaaggcagcagcaaaagaaactgatgatatcagcaggactgtgcagagttccctggaagaatgtcagccacaggaggccctcactcctccctcaccacggaccagcagagggaggcgggaatgctggggagccccagcctcccacccctgcctcctcacattcttcctccctccatgtcctctccttcttctccttccttattcttgccttgattctttctctctttatattctttaactgcacttctgaactctgtgttaagttgctacattgtgaggactgtgtctaacagtgagatttattattgggactgcacaaatcacttgtgaataaaatgtttaacggtgaaa

SEQ ID NO: 414481 - DNA, 1897 bp, Homo sapiens
agcggaaaacccggcctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaagctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 414482 - DNA, 1636 bp, Homo sapiens
agcggaaaacccggcctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccag

SEQ ID NO: 414483 - DNA, 1082 bp, Homo sapiens
  misc_feature (36)..(36): n is a, c, g, or t
gtaccataacaaaattagacaaccaaaaaacctctntgctacgccttgtgccttgctggagtacaatgatgcaatctccgctcactgcaacctgtgcctcccgggttcaagtgattctcctgcctcagcctcccaagtagctgggattacagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 414484 - DNA, 1505 bp, Homo sapiens
agcggaaaacccggcctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaaggtcagtatgaagcagagtgaattggaaatcctttggcacatgtcctaaataaggcaggaaaacaagtagttctccgtatatttcttcatacttcttcatactttttctcatactttttttttttaattatctaaagggaaagagaggaaaagtagctggtcctcttaaggctttggcacttctagagtatttgaaattggtggtttgtttgtttatttgtttatctgagacagtgtctcgctctgttgctcacgctggagtgcagtggtgcaaacactgctcactggagccttgacctcctgggctcaagtggtcctgccacctctgtctcccaaagtgctggaataacaggtgtgagcctctgcaccctgcctgaaattggtgatataagaaacacttaggaaaaaaaaaaaaaaag

SEQ ID NO: 414485 - DNA, 1661 bp, Homo sapiens
agagaacgcgctcgcgtagaggaattccgggtcctcctcctcgccctaccttggtttacctgcagccgcctagtcctcttctccttctctttgatgattcagggcctcggcttccctcacggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccag

SEQ ID NO: 414486 - DNA, 2214 bp, Homo sapiens
agcggaaaacccggcctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacaggtgtctctgatgcatattctcagagcctaccaggaaaatcctagaatcgagaagggcttgggacacagagagctagtggttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 414487 - DNA, 1931 bp, Homo sapiens
agcggaaaacccggcctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 414488 - DNA, 1833 bp, Homo sapiens
agcggaaaacccggcctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacaggtgtctctgatgcatattctcagagcctaccaggaaaatcctagaatcgagaagggcttgggacacagagagctagtggttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccag

SEQ ID NO: 414489 - DNA, 341 bp, Homo sapiens
tttctttctaacactccacacacatcccattggtatcatacaaaccttgtttcttagctcattttaaaattccgattgtttatcttagtgtttctggcccttggtctttattattagattgagagaattctctcaaagtggaaacctacaattcacataggcaagaaattatgcaacatttaccttatagcataaatcaaagaaatttctcctaaatatgtttttataaaatgcctccccaaagatgatcatttactttaatgaaaataaatcattagcaaggtaaagactgaacagagttttataggccaccaataaataatttcttagtaggttactta

SEQ ID NO: 414490 - DNA, 3945 bp, Homo sapiens
aatggtcagtcaatacattataacataatacaccaaatgctagaatagaaggggaggggggcacacataatgactcactgctggaagaagggtgcatcagtgaattaaaaaatgtccctcccctcttcagcactcagcgcgcagctatttccttctgccagtctctttgaactctggatctttgcttttgctcgctgctctcctgtttttcattctccacattttctcaatcctctttctttatccttagccaccctgcttttttcctccttttttaaaaaatcggagatttcgtcttaaaatgatttgtcttccttaccttcgtccatttcaacactgaaggctgcaaagaacttcacctttcccctagtggtatttaaaaattctcaatccgtaaaaagtctttttgaaaggcaaaggaacaggacccagaccctctcgacacccttgatccgagtcagatctgcactagcaaccagaactaatatttcatttaacccaccaaaagggggaggcgagaggagccagaagcaaacttcatctgtctcagacggatccgtggttcctacatttggaggagccgcgtgtcagaaggcgtaggaccccaaggggggacaaggaggactcccgagtctcccttctccgctctccgagaccgaagaggtggactgagccgctcgggacagcggcaccggaggaggctcggagaagatgcggggctcggggccccggggtgcgggacaccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagcattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtttgcagcatccagcgatcaaagccagattcctgtaattgctgtgtctgtgacagtaggagtcattttgttggcagtggttatcggcgtcctcctcagtggaaggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgccaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtct

SEQ ID NO: 414491 - DNA, 4011 bp, Homo sapiens
  misc_feature (2558)..(2558): n is a, c, g, or t
aatggtcagtcaatacattataacataatacaccaaatgctagaatagaaggggaggggggcacacataatgactcactgctggaagaagggtgcatcagtgaattaaaaaatgtccctcccctcttcagcactcagcgcgcagctatttccttctgccagtctctttgaactctggatctttgcttttgctcgctgctctcctgtttttcattctccacattttctcaatcctctttctttatccttagccaccctgcttttttcctccttttttaaaaaatcggagatttcgtcttaaaatgatttgtcttccttaccttcgtccatttcaacactgaaggctgcaaagaacttcacctttcccctagtggtatttaaaaattctcaatccgtaaaaagtctttttgaaaggcaaaggaacaggacccagaccctctcgacacccttgatccgagtcagatctgcactagcaaccagaactaatatttcatttaacccaccaaaagggggaggcgagaggagccagaagcaaacttcatctgtctcagacggatccgtggttcctacatttggaggagccgcgtgtcagaaggcgtaggaccccaaggggggacaaggaggactcccgagtctcccttctccgctctccgagaccgaagaggtggactgagccgctcgggacagcggcaccggaggaggctcggagaagatgcggggctcggggccccggggtgcgggacaccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagcattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtttgcagcatccagcgatcaaagccagattcctgtaattgctgtgtctgtgacagtaggagtcattttgttggcagtggttatcggcgtcctcctcagtggaagttgctgcgaatgtggctgtgggagggcttcttccctgtgcgctgttgcccatccaancctaatatggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgccaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtct

SEQ ID NO: 414492 - DNA, 342 bp, Homo sapiens
tctgtaaagatttgaaatcttaaattaacagcatcatgccaattaggctgaaattctgttaaaatttttattttagaacttgaggataagcggtaaaaaaattatatttaaaaatagactttatggagatttgtttcaaagaaaaaatcttattcttacatactatattttgtagcacatgcatctgtgtgctactggagaacgtaggatcttgttactttaaaaaaattaatgtttgtagtaaataataaatgataaaatatatttttctttattgaaaaggtatattttagtgaaaatatacttggatgtttatttcttcattttgattttatattttca

SEQ ID NO: 414493 - DNA, 538 bp, Homo sapiens
ctgtaagcccagactttctagggctgatagagctggagtggacatggccccaaagggggctgtgaacaggaagtccccgggatgagacagcctcagtctctccaccctagggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggcaagtgcgtcctcagccagggagggaagggcagggcccttctccaagaggggtgtcccaaggtcctgcgtgagcgctgactccggatctcagtgtgagtagggcttttcatggtccctgtgaccctttccttcccctgtgacagagtggggaggggccagcggccagactgtggagtgactctacttct

SEQ ID NO: 414494 - DNA, 2202 bp, Homo sapiens
  misc_feature (1342)..(1342): n is a, c, g, or t
ttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagagcgcagactaccagaacctctgccatctccgatactgtgagtcaggccaaggtccaagtcaacaaggccttcctggactcccgaaccaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcntgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggcaagtgcgtcctcagccagggagggaagggcagggcccttctccaagaggggtgtcccaaggtcctgcgtgagcgctgactccggatctcagtgtgagtagggcttttcatggtccctgtgaccctttccttcccctgtgacagagtggggaggggccagcggccagactgtggagtgactctacttct

SEQ ID NO: 414495 - DNA, 2743 bp, Homo sapiens
  misc_feature (1342)..(1342): n is a, c, g, or t
ttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagagcgcagactaccagaacctctgccatctccgatactgtgagtcaggccaaggtccaagtcaacaaggccttcctggactcccgaaccaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcntgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggcc

SEQ ID NO: 414496 - DNA, 378 bp, Homo sapiens
agactagtatgggtaaggtggggaacccctacttcagaaggtgaaccccagaaggaagctgcctgggccaggggtgtgtgcatgatggcagggagctgcagccactaagccttggaagagtctttaatggcacagggaaatgccctgtataaagctcagtgggggaaaaaaaggatttagaaagaaagtatatgccagaggcaaagaaaaagactagaagaaaataaccagccaggtgcagtggtgtgcacctgtgatcctagctactcgggaggctgaggtgggatgattgcttgagcccaggtgtttgaggctgcagtgagctatgatctgtgtcactgcattccagcctgggtgacagagtgagaccccatctgt

SEQ ID NO: 414497 - DNA, 299 bp, Homo sapiens
atcccccaaaaagagtgatctaaaagagagagagagcaggaggaagctgtgatatcttttatgacctaactacataccatcacttctattgtattctactcattggaagcaagtcactaagtccagcccacattcaaggagagatgaattagggtccatctgttggagagaagaatgtcaataattttgtgatatattttaaaaccatcacacactggttttgggaggctgaaagagcaaaaggggaatgccattgtgagcccaatgtcggtacctgtggtaagtagctactactgggg

SEQ ID NO: 414498 - DNA, 265 bp, Homo sapiens
atttaaataggaattctgtccattcatttcacatgtgtatcctgggaggcgtatcctgggagtgttcagcaggtgtctgggaggtttactcgtgtccctgaagtgcatgctgctaacgggagctatgcacagagaaacacctgaatgctcaagggcaagcagacagctcctgtaacctgtgcagataacagtgtggcccaggctgttgagactgtgcacacctgggagagggcaggtaggcaggatgcagcctgctagagcagct

SEQ ID NO: 414499 - DNA, 1341 bp, Homo sapiens
  misc_feature (4)..(5): n is a, c, g, or t
  misc_feature (20)..(21): n is a, c, g, or t
  misc_feature (26)..(26): n is a, c, g, or t
  misc_feature (29)..(29): n is a, c, g, or t
  misc_feature (31)..(32): n is a, c, g, or t
  misc_feature (96)..(96): n is a, c, g, or t
  misc_feature (106)..(107): n is a, c, g, or t
  misc_feature (997)..(997): n is a, c, g, or t
  misc_feature (1000)..(1000): n is a, c, g, or t
  misc_feature (1171)..(1171): n is a, c, g, or t
catnnggggacgctctcagnncttgntcncnncccagcttccttcaaaatatctgctgttcatgaaatcctgtgcaagctcagcttggagggtgancactctacanncccaagtgcatttgggtcagtcaaagcctacaccaaatttgatgctgagcaggatgctttgaacattgaaatggccatcaagaccaaaggtgtggatgagatcaccactgtcaacattttgactaaccacagcaatgcacagagacaggatattgccttcacctaccagagaaggaccaaaaaggaacttgtatcagcacttaagtcagccttatctggccacctagatagtggctttgggcctattaaagacacctgctcagtatgatgcttctgagctaaaatcttccatgaaggggctgggaaccaacaaggactccctcattgagatcatctgctcaagaaccaaccaagagctgcaggaaattaacagagtctacaaggaaatgtacaagactgatctggagaaggacattatttcggacacatctggtgacttctgcaagctgatggttgccctggcaaagggtagaagagcagaggatggctctgtcattgattatgaactgattgaccaagatgcccgggatctctatgacgctggggtgaagaggaaaggaactgaagttcccaagtggatcagcgtcatgaccgagcggagcatgtcccacttccagaaagtatttgataggtacaagagctacagtccttatgacatgttggagagcatcaagaaagaggttaaaggagacctggaaaattctttcctgaacctggtccagtgtattcagaacaagcccctgtatttcgctgaccggctgtacgactccataatgggcatggggactcaagataaggtcctgatcagaatcatggtctcccacaatgaagtggacatgttgaaaattaggtctgaattcaagagaaagtatagcaagtccctgtactantanatccagcaagacactaagggtgctgtacctgtgtggtggagatggctgaagtccgacacagcacgagcgtccagaaatggtgctccccatgcttccagctaacaggtctagaaaacccgcttgtgactagcagtccctgtggctgttcctgtgaggatgacgttagcattncccccaacctcattttagttgcctaagcattgcctggctttcctgtctagtctctcctgtaagccaaagaaatgaacattccaaggaattggaagtgaagtctatgatgtaaacactttgcctcctgtgtactgtgtcataaacggattaataaactgaatttgtacttt

SEQ ID NO: 414500 - DNA, 1203 bp, Homo sapiens
aagactttgactggcttgtgtataggccaattgggtctgccttgagctgccgactgatcggcccttggggcatcggaatgtgggagacgggttttccccttctgagcagcgtctcactgagccagtgagcaggaagcgcgcggtaggttgggcttctccaggaggcagcggtttgactccaatggggaatgcgggatcgggcggttaaacggatggaacgaatctggaaccagtagacggacagcctaaggaaagcgctgggaccagtcgtccaatcggctctccaaaagagggaggtcttcgatttggggttgtgaggaaggggagtcggtgcctgtaatggcgtgtgagggtggatgttttatccacgatgacttctctaacgaagcctttaggcctcagtcccatacacctccttgaaagcgtaagtttgctcctgtattcctcgacttgagcatttttcccccgccccctcaccacttgaggtttggggaacaggagttgtttttttttgtttgtttgtttttaaataatactttcagaagtcgcttctttaggaagactgttaaaatgttagaacgaatgggagaaatctctatgtactgtcatggaaaggcgttcaagaaatatctccttcctgatagtgcatatttctactgacaaatatgtttgtaggtccacagaaaagttttggaaagctacacaccaaagtgtcaatcctagggacacagtaggatcgaggcagattagatctttaatgtttaaaactttgcaaggttaataatttgtgattaaaattaaataaaaaatgaagtcgattgttttgtgtttctagtcataatcacatacttacaaccccttttctgttttatgtaatccatgtgcccagtgcttttattttagtctctttctcccgggaactttcatatatttcttttctttacaccattgaagatatcctaaagtccctctttttgctgttcctttgaggatatctgactttggaataaaaaagaaacaaagagggtaatatttagggttctggggacagaagattcatccatcacctggattattccttgccttttaattagatttccttcgaagtgtgttttacatgcagtctatctccttttggtaatgcccactctgcttattccaggatcttttggagaaataaataaattttgataacattggctg

SEQ ID NO: 414501 - DNA, 331 bp, Homo sapiens
tgtctaactccattattaaagattcagatttgatatcacttgctaaaaaagtacccaaactaatttcagtaaatttggtgaagttgaaaacaaagcaaaagtttaggctttaaagtttgagcctaattcacattttacccccttcctggtttctatatccaatataagcaaaaccaaaggccagtcctttagtccttatttgtggctgaggtacaccgtggtctgtgtgcacaagctgtgatttatgttgttactattacttcccatctataacttctttaagccacattaaaaatgtgtaagaaggctatatcattctatatgggggcgg

SEQ ID NO: 414502 - DNA, 361 bp, Homo sapiens
aggattctgggggcttagagagggcagcctggagaagccagagttaagctcagaacaagaggtgcaggaagagccacagcagggaagggaagagagatcccagaggaggggcagagtgtggcaggacaagggccctgccgtacatgctatgcatgaaggaaaatcttgagactaagactcatgaaaagatccaaaataattatttcgtgtggcccctagaagactgaagagacatttgcttcgccatttgcccagggctgcctgggcaggagacaaaggaatgaaaagtccagggggaaagcaaaaatctatggcttctgaacacatgctccccggagctcgtctccacagcatcttcacc

SEQ ID NO: 414503 - DNA, 2545 bp, Homo sapiens
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaaggtaaataaacactcttcaaaaatgtaaccagaaagcaagaagttttatcttcatttctatcaatattactggtatttgtggattaaatgaaagttaacttcggtagttctaaatcactatggaaaatcttcacgaaaagggttcactacactactggaattgatgatcttgtttccgttacatgccttttgagaatctgaaggtaatatatgatccccatatatgcaccagtttgtttttttgttgttgttgtttgttttctttgtttttttgttttgttttgtttttgtttttgaaatggagtc

SEQ ID NO: 414504 - DNA, 4179 bp, Homo sapiens
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaactgtgagattttcctgtgtaatttgggtagattttcaagagtgtgaacacaaatttaaaataagctataatcagcaacaacacaatgacaatgacatcttccccttaccttagccactaagaagacaagggctgttactcatataacttgcttttattacttaatgtacaccaaactgttgttgtcaattatcttttatttaacttctccaccttcattgctagatccttcgaacagcactgatacatttcaaggtcttgttttaggataactactttaaaattttttaaattatattaaatttataaaataatttataaattcatatattaaaacaatataagataatttcttgatttgtcatttataaatcctaaagtatatttgtttaatggcctatttttagatgaagaaaaagccagttggtaagctgtgttagtcatgtatcagttcagacagacgaggtctcaatttaactccaggcttagatccagtttcttttgcccttcactatttgaggtaacttcatttttcattctagttttgatatttggctgtttatttttgtcattttccattatttcaaagggaatttggaacatgttgaattttatcaggtggttacataagcaagagtacatcaaactgtattatttgaaagtctagaacctgtcatgtgaaattactatttttgagccctctatgtggtccaggcagaatagtagacacactgatatttaatccttaaaacccctttaaatgagggccagtattatctctgctttcagaagtagacataataggatgaatcatataacagaaaaaaaaaagtgaagccaagagggagttaactacttaaagtacatgctatgctatactttctagagagatcacagatgtgtgtgaacatcctagcaattaacacaaagaaggaaccatcacattaattacacaatttattgtgtctgaggtaacccagtttcttgagagaagcgtaactattttcaaaagtgggaaagatcttttcataaagacgttgccagaaatagcaacattctcaatactcgtggtgtaaaaaccatgaatcccctggcttaatgccaaattatagccttagaagaataattgttccccaaatgggcaagaaaggttctaattgtcaagagtaacccaagtaagaacttttggaatatcaaaggaaatgagcaaaatgtaaatagaggggatatgtactttgctgagtattaaattggaact

SEQ ID NO: 414505 - DNA, 3966 bp, Homo sapiens
ttcacatcaagaaagtaagacatttaattaaccacttcattacttttggacattgagcttggctgcaggttttatggtcactgtcatgaaagcagccttaaatatttatataaacagtgtttcaaaatcatttacattatctccctattatgatttgttaaagctggaaggattgtgtagctcacttaagttccgctccctcgtttcacagacaaggaatctgattttgagtaatatttctgcagttacgtggcttgtaagtggcacagctaggccttgcgcccaggcagtctggcaccagagtctgctcttgaccactgtactcttatgcgtctctgctgaattgagccttagttagctaagatactgccacttcaaagagtgtttttaaaattggaatgctttagtaactttcaatgttgagcatttttctgtatgaaaatgtgttatccaatgatgttttttccttagtttctggctgaatgacaagtgcatgatgaccttgcaggtacagtagttctgtgtaaatattctaaagaataattaagttgaatgattctgtggcaacttaaattgatactcattttactcacagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaactgtgagattttcctgtgtaatttgggtagattttcaagagtgtgaacacaaatttaaaataagctataatcagcaacaacacaatgacaatgacatcttccccttaccttagccactaagaagacaagggctgttactcatataacttgcttttattacttaatgtacaccaaactgttgttgtcaattatcttttatttaacttctccaccttcattgctagatccttcgaacagcactgatacatttcaaggtcttgttttaggataactactttaaaattttttaaattatattaaatttataaaataatttataaattcatatattaaaacaatataagataatttcttgatttgtcatttataaatcctaaagtatatttgtttaatggcctatttttagatgaagaaaaagccagttggtaagctgtgttagtcatgtatcagttcagacagacgaggtctcaatttaactccaggcttagatccagtttcttttgcccttcactatttgaggtaacttcatttttcattctagttttgatatttggctgtttatttttgtcattttccattatttcaaagggaatttggaacatgttgaattttatcaggtggttacataagcaagagtacatcaaactgtattatttgaaagtctagaacctgtcatgtgaaattactatttttgagccctctatgtggtccaggcagaatagtagacacactgatatttaatccttaaaacccctttaaatgagggccagtattatctctgctttcagaagtagacataataggatgaatcatataacagaaaaaaaaaagtgaagccaagagggagttaactacttaaagtacatgctatgctatactttctagagagatcacagatgtgtgtgaacatcctagcaattaacacaaagaaggaaccatcacattaattacacaatttattgtgtctgaggtaacccagtttcttgagagaagcgtaactattttcaaaagtgggaaagatcttttcataaagacgttgccagaaatagcaacattctcaatactcgtggtgtaaaaaccatgaatcccctggcttaatgccaaattatagccttagaagaataattgttccccaaatgggcaagaaaggttctaattgtcaagagtaacccaagtaagaacttttggaatatcaaaggaaatgagcaaaatgtaaatagaggggatatgtactttgctgagtattaaattggaact

SEQ ID NO: 414506 - DNA, 1416 bp, Homo sapiens
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcaggtacagtagttctgtgtaaatattctaaagaataattaagttgaatgattctgtggcaacttaaattgatactcattttactcacagggtcatacagctgcagtgtgggcggtaaagatcttacctgaacagggcttaatgttgactggatcagcagacaagactgttaaactgtggaaggctggaagatgtgagaggactttttcaggtaagatcagggtagacaagttttataatatcattgctttttatttgctcagattttttttctcagaagtttacaagcatgaaaatatttgaaaaacattagtatatttaagctattaatttgagttaatgtaatttttctgatgagttaatatctaatacatttaaaaagataatgaaaccctgtctctactaaatacaaaaaaattagccgggcatggtggcgcatgcatgtaatccaagctacgtgggaggttgaggcaggagaatcacttgtgcctcggaagcggaggttgcagtgagccaagattgcaccattgcactccagcctgggcaacagagcaaga

SEQ ID NO: 414507 - DNA, 429 bp, Homo sapiens
tggtgacattgtggttggtgcgaggtatttatattctagtcaatcattaaatgttatatgtctaggccttcagtaggaactagagtgtacagagataagccataaggaatttcacgtgacttgaggagactatatggacacttcaattactaaacaaaacagtagtagatattatagctttcatactaagggatgcatgatataccagtattgtactgcaattgtgcagtcaatgatgcatgatataccagtattgtactgcaattgtgcagtcaagatattgactacaaaagaagttagagaaggtagagattggtgtgggaaaactttctgtagaagaagaaatttgaactggattttgaaagattatgagtgagaaaagatacgcaaatttttgtcaaagctaagagtataagtttccttcatgag

SEQ ID NO: 414508 - DNA, 2973 bp, Homo sapiens
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgct

SEQ ID NO: 414509 - DNA, 4233 bp, Homo sapiens
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaactgtgagattttcctgtgtaatttgggtagattttcaagagtgtgaacacaaatttaaaataagctataatcagcaacaacacaatgacaatgacatcttccccttaccttagccactaagaagacaagggctgttactcatataacttgcttttattacttaatgtacaccaaactgttgttgtcaattatcttttatttaacttctccaccttcattgctagatccttcgaacagcactgatacatttcaaggtcttgttttaggataactactttaaaattttttaaattatattaaatttataaaataatttataaattcatatattaaaacaatataagataatttcttgatttgtcatttataaatcctaaagtatatttgtttaatggcctatttttagatgaagaaaaagccagttggtaagctgtgttagtcatgtatcagttcagacagacgaggtctcaatttaactccaggcttagatccagtttcttttgcccttcactatttgaggtaacttcatttttcattctagttttgatatttggctgtttatttttgtcattttccattatttcaaagggaatttggaacatgttgaattttatcaggtggttacataagcaagagtacatcaaactgtattatttgaaagtctagaacctgtcatgtgaaattactatttttgagccctctatgtggtccaggcagaatagtagacacactgatatttaatccttaaaacccctttaaatgagggccagtattatctctgctttcagaagtagacataataggatgaatcatataacagaaaaaaaaaagtgaagccaagagggagttaactacttaaagtacatgctatgctatactttctagagagatcacagatgtgtgtgaacatcctagcaattaacacaaagaaggaaccatcacattaattacacaatttattgtgtctgaggtaacccagtttcttgagagaagcgtaactattttcaaaagtgggaaagatcttttcataaagacgttgccagaaatagcaacattctcaatactcgtggtgtaaaaaccatgaatcccctggcttaatgccaaattatagccttagaagaataattgttccccaaatgggcaagaaaggttctaattgtcaagagtaacccaagtaagaacttttggaatatcaaaggaaatgagcaaaatgtaaatagaggggatatgtactttgctgagtattaaattggaact

SEQ ID NO: 414510 - DNA, 1954 bp, Homo sapiens
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtaagttagtgtttatattgagtcttatgtagttccattagtgttgattgatttttttgatgttttcaaatagtcatgtgattagctttttcaataaataccaatatctacagcagggt

SEQ ID NO: 414511 - DNA, 5039 bp, Homo sapiens
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttgatttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaaaatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctctcgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaacaaaaaaaaaaaaacaaaaaaaaaaaaaaaaaaaaaaaaaaaaaaaaaaaaaaaaaaaaaaaaaaaaaagaaccaacacaggaggagagcacaacaaaaagctattccaggcgaagacccgacgcaacgacggtatgaaaaacgacgcggcggcactcattagaacgagggagcgcagggaccgactacaaccagaggagaagcggcgccaactcaaccacaaacagctgctccgcgccgcggcgacaacggcctccctgcggggagaaaatccgcgcaggagaagcccccccagaccaccaggtggggggggagacccataacacggggcaagcaggaccactcaacgtgctgttcgacacgacctccgacgagacaactaacacaccccgcagagagctaacggcgtcaaaacagaacgatattgacagcgccacacgaaagcatcgcgacccggcaaagaccacggacaaccgacctccagggacggctaaaaagagaacggcgcgacacgcacgcccg

SEQ ID NO: 414512 - DNA, 4980 bp, Homo sapiens
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttgatttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaaaatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctctcgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaacaaaaaaaaaaaaacaaaaaaaaaaaaaaaaaaaaaaaaaaaaaaaaaaaaaaaaaaaaaaaaaaaaaagaaccaacacaggaggagagcacaacaaaaagctattccaggcgaagacccgacgcaacgacggtatgaaaaacgacgcggcggcactcattagaacgagggagcgcagggaccgactacaaccagaggagaagcggcgccaactcaaccacaaacagctgctccgcgccgcggcgacaacggcctccctgcggggagaaaatccgcgcaggagaagcccccccagaccaccaggtggggggggagacccataacacggggcaagcaggaccactcaacgtgctgttcgacacgacctccgacgagacaactaacacaccccgcagagagctaacggcgtcaaaacagaacgatattgacagcgccacacgaaagcatcgcgacccggcaaagaccacggacaaccgacctccagggacggctaaaaagagaacggcgcgacacgcacgcccg

SEQ ID NO: 414513 - DNA, 2913 bp, Homo sapiens
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttgatttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagggttctggttggatttcttctttgtccgggttacttatttatggggactacgggttctgaaatttaggttt

SEQ ID NO: 414514 - DNA, 4985 bp, Homo sapiens
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttgatttcatttttctgacaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaaaatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctctcgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaacaaaaaaaaaaaaacaaaaaaaaaaaaaaaaaaaaaaaaaaaaaaaaaaaaaaaaaaaaaaaaaaaaaagaaccaacacaggaggagagcacaacaaaaagctattccaggcgaagacccgacgcaacgacggtatgaaaaacgacgcggcggcactcattagaacgagggagcgcagggaccgactacaaccagaggagaagcggcgccaactcaaccacaaacagctgctccgcgccgcggcgacaacggcctccctgcggggagaaaatccgcgcaggagaagcccccccagaccaccaggtggggggggagacccataacacggggcaagcaggaccactcaacgtgctgttcgacacgacctccgacgagacaactaacacaccccgcagagagctaacggcgtcaaaacagaacgatattgacagcgccacacgaaagcatcgcgacccggcaaagaccacggacaaccgacctccagggacggctaaaaagagaacggcgcgacacgcacgcccg

SEQ ID NO: 414515 - DNA, 2239 bp, Homo sapiens
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaacaaaaaaaaaaaaacaaaaaaaaaaaaaaaaaaaaaaaaaaaaaaaaaaaaaaaaaaaaaaaaaaaaaagaaccaacacaggaggagagcacaacaaaaagctattccaggcgaagacccgacgcaacgacggtatgaaaaacgacgcggcggcactcattagaacgagggagcgcagggaccgactacaaccagaggagaagcggcgccaactcaaccacaaacagctgctccgcgccgcggcgacaacggcctccctgcggggagaaaatccgcgcaggagaagcccccccagaccaccaggtggggggggagacccataacacggggcaagcaggaccactcaacgtgctgttcgacacgacctccgacgagacaactaacacaccccgcagagagctaacggcgtcaaaacagaacgatattgacagcgccacacgaaagcatcgcgacccggcaaagaccacggacaaccgacctccagggacggctaaaaagagaacggcgcgacacgcacgcccg

SEQ ID NO: 414516 - DNA, 466 bp, Homo sapiens
agtccgtgtacaggtagccatggctgctcacccactcgcaggtcgaccataagccttcatacatctcaagttgggggacacaaaagggggaaggggggcacgaaaggctcatcattcaaaataaaacaaaataacagagtcttaaggcgaagattaaaaacattgtgcattacatcatttacacgaaagcaatgctatcacctccccagtgtggagagctctctccacactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcacatccacacaggcgagacaccctaatctgctcggccagtctggagagagaggacctctagaacaccaca

SEQ ID NO: 414517 - DNA, 707 bp, Homo sapiens
aggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggaataggatgcctctcactcacactgcagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaag

SEQ ID NO: 414518 - DNA, 865 bp, Homo sapiens
  misc_feature (841)..(841): n is a, c, g, or t
aggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtncacccgaggagacaacgagaaggt

SEQ ID NO: 414519 - DNA, 852 bp, Homo sapiens
  misc_feature (828)..(828): n is a, c, g, or t
tcagctcggtaccttcttgcacccatggttgtagttctaaggaggtgggatgtgggattctgccaagacgtgggcagccctcaccccaaccagttcagccaaaagtgagggtgcctccctgggtggggacccagcaccaaaccacagtccttgaccccacagagagagcgtcgacgctctctctgtggggggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtncacccgaggagacaacgagaaggt

SEQ ID NO: 414520 - DNA, 5587 bp, Homo sapiens
aattccgggcgccagtcccgctccgcgccgcgccgctccgctccggctcgggctccggctcgcctcgggctgggctcgggctccgggggcggcgtccccgcgccgggccccgggacgcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcccgaggccgaacgcttcctcttgcaacggcagagcggggcgctggtgccggcggcgggcgtgcggcacatcagccaccgcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccacaaaaaa

SEQ ID NO: 414521 - DNA, 5605 bp, Homo sapiens
aattccgggcgccagtcccgctccgcgccgcgccgctccgctccggctcgggctccggctcgcctcgggctgggctcgggctccgggggcggcgtccccgcgccgggccccgggacgcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcccgaggccgaacgcttcctcttgcaacggcagagcggggcgctggtgccggcggcgggcgtgcggcacatcagccaccgcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatattcggataaaccgagaaggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccacaaaaaa

SEQ ID NO: 414522 - DNA, 1794 bp, Homo sapiens
  misc_feature (30)..(30): n is a, c, g, or t
aacaatggctatggatcgaggcccctgggntgttaatcggacagggctcatcgtatcctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccacaaaaaa

SEQ ID NO: 414523 - DNA, 3772 bp, Homo sapiens
aattccgggcgccagtcccgctccgcgccgcgccgctccgctccggctcgggctccggctcgcctcgggctgggctcgggctccgggggcggcgtccccgcgccgggccccgggacgcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcccgaggccgaacgcttcctcttgcaacggcagagcggggcgctggtgccggcggcgggcgtgcggcacatcagccaccgcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggagagaccactatgcctactcctactacccgaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggacatgcaaggttacatgcaagcccggtacatgcaag

SEQ ID NO: 414524 - DNA, 407 bp, Homo sapiens
gtgaggcctccactggccaggccaatgggccgcctgctcccaggtcctctgtgtattcagggccatggtccccaaagccaaaagttgggtcccagctctgccatctatttattgtgtgatgaatcatacaccttcccagagcctcagtttcttcatctgtaaaacaagggtgtcagatgggagatcactagttgctctttttcttttcttttttttgagacaaggtctcactcttttgcccaggctggagtgcagtggcgcgatcacagctcactaagttgtgcagcctcgacctcttgggcccaagccatccttccacctcagcctatcgagtagctgggactacaggctgcatcaccacagctgtctgatttttttttttttttttttttttcagtagagacaag

SEQ ID NO: 414525 - DNA, 5593 bp, Homo sapiens
aattccgggcgccagtcccgctccgcgccgcgccgctccgctccggctcgggctccggctcgcctcgggctgggctcgggctccgggggcggcgtccccgcgccgggccccgggacgcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggaccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcccgaggccgaacgcttcctcttgcaacggcagagcggggcgctggtgccggcggcgggcgtgcggcacatcagccaccgcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggagagaccactatgcctactcctactacccgaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccacaaaaaa

SEQ ID NO: 414526 - DNA, 4814 bp, Homo sapiens
aattccgggcgccagtcccgctccgcgccgcgccgctccgctccggctcgggctccggctcgcctcgggctgggctcgggctccgggggcggcgtccccgcgccgggccccgggacgcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcccgaggccgaacgcttcctcttgcaacggcagagcggggcgctggtgccggcggcgggcgtgcggcacatcagccaccgcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggagagaccactatgcctactcctactacccgaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctcccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccacaaaaaa

SEQ ID NO: 414527 - DNA, 174 bp, Homo sapiens
tgacaaccagacctaccgaggcttctggaacccaccacttgagcctaggaaggcctatctcatctacttccaggcagcaagccacctgaagggggtgagggaccggccagggtcatggtgggcgtggttgggtgtggggggatggcagacaggagataccttggagcaggccca

SEQ ID NO: 414528 - DNA, 5224 bp, Homo sapiens
tggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414529 - DNA, 5496 bp, Homo sapiens
tggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtgaaaaaaaaaaaaaaaaaaaaaaactctcgagaacattagttttcttcttcttcctcctttaagagttgaaaccccaagaccgaaacgtttttaagggcccaaaaagggcagtttttgaaagggtttttcccacagcccccacaaaaagagaaaaaagatttccgcaggttttcacccaacttttcggggcggccaaaaacaccttggaatctccggaaaaacgggccccaaattttttcctcggaaaaagccccccccgaggaaaaaacacc

SEQ ID NO: 414530 - DNA, 286 bp, Homo sapiens
cctagttttagaagtttcaatatcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414531 - DNA, 318 bp, Homo sapiens
gagaaagttgtgacagagcgagtgatatgagctatctaggatgggccggagcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaaggtaaagctgaggaaggcctg

SEQ ID NO: 414532 - DNA, 5622 bp, Homo sapiens
tttttaaaaaaggaaaaactatgtgggatagattcagtcggccagctgccagccctggcttgtggaatgttttgttgaacgactataggtatagccatggactttttgggatcccttggtgtgtgcagtcggccagctgtgatgcattttcctggcatttgtgagttagctggcctgcgtgtccactgccccatatgacaacaggcctgcttctcccatcctgccccccagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggagtgagtgtgggacttgggcagggaggcggaggcaggcagcacttcccgggcctctgggggccccagggctgcctatgctgggagaggaatgaaatgtccattccaaacaggtttcccaatgctgccttcccgcctggggtggtggggctagtgtgtaaggcaggagtcatgtcttgggaggaggaggtgccttctgttccactgtttccagcagtgccctgggcatgttctgtgagaccaggccagacctggtagtaggggtccgaggtcacaatttgctctctgctgagacctcagattgagtggtgaggcttgccctagcggctcctttgacatggtcagagttggatcagcacccagcacccacctggccctgttgctccccacagccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414533 - DNA, 5386 bp, Homo sapiens
ctctagaggatctccctgtagtcgctcttggagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggagtgagtgtgggacttgggcagggaggcggaggcaggcagcacttcccgggcctctgggggccccagggctgcctatgctgggagaggaatgaaatgtccattccaaacaggtttcccaatgctgccttcccgcctggggtggtggggctagtgtgtaaggcaggagtcatgtcttgggaggaggaggtgccttctgttccactgtttccagcagtgccctgggcatgttctgtgagaccaggccagacctggtagtaggggtccgaggtcacaatttgctctctgctgagacctcagattgagtggtgaggcttgccctagcggctcctttgacatggtcagagttggatcagcacccagcacccacctggccctgttgctccccacagccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414534 - DNA, 5585 bp, Homo sapiens
tttttaaaaaaggaaaaactatgtgggatagattcagtcggccagctgccagccctggcttgtggaatgttttgttgaacgactataggtatagccatggactttttgggatcccttggtgtgtgcagtcggccagctgtgatgcattttcctggcatttgtgagttagctggcctgcgtgtccactgccccatatgacaacaggcctgcttctcccatcctgccccccagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggagtgagtgtgggacttgggcagggaggcggaggcaggcagcacttcccgggcctctgggggccccagggctgcctatgctgggagaggaatgaaatgtccattccaaacaggtttcccaatgctgccttcccgcctggggtggtggggctagtgtgtaaggcaggagtcatgtcttgggaggaggaggtgccttctgttccactgtttccagcagtgccctgggcatgttctgtgagaccaggccagacctggtagtaggggtccgaggtcacaatttgctctctgctgagacctcagattgagtggtgaggcttgccctagcggctcctttgacatggtcagagttggatcagcacccagcacccacctggccctgttgctccccacagccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414535 - DNA, 5807 bp, Homo sapiens
tttttaaaaaaggaaaaactatgtgggatagattcagtcggccagctgccagccctggcttgtggaatgttttgttgaacgactataggtatagccatggactttttgggatcccttggtgtgtgcagtcggccagctgtgatgcattttcctggcatttgtgagttagctggcctgcgtgtccactgccccatatgacaacaggcctgcttctcccatcctgccccccagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggagtgagtgtgggacttgggcagggaggcggaggcaggcagcacttcccgggcctctgggggccccagggctgcctatgctgggagaggaatgaaatgtccattccaaacaggtttcccaatgctgccttcccgcctggggtggtggggctagtgtgtaaggcaggagtcatgtcttgggaggaggaggtgccttctgttccactgtttccagcagtgccctgggcatgttctgtgagaccaggccagacctggtagtaggggtccgaggtcacaatttgctctctgctgagacctcagattgagtggtgaggcttgccctagcggctcctttgacatggtcagagttggatcagcacccagcacccacctggccctgttgctccccacagccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaaggtgggctgggtgagcagggtagaggggctctggctccgggccccacccttaggagtcgaggccctgagtgtccgtccctggcccccaccccttcctcagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtcagtgcccagtcctctgctctttcccggagccacctggagcccagccccatggttcacctggagctggcccttctgcccaccaggtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414536 - DNA, 2862 bp, Homo sapiens
ttcacaagcgtttgggcctcatccacacagcagtcccttccactccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414537 - DNA, 5800 bp, Homo sapiens
tttttaaaaaaggaaaaactatgtgggatagattcagtcggccagctgccagccctggcttgtggaatgttttgttgaacgactataggtatagccatggactttttgggatcccttggtgtgtgcagtcggccagctgtgatgcattttcctggcatttgtgagttagctggcctgcgtgtccactgccccatatgacaacaggcctgcttctcccatcctgccccccagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggagtgagtgtgggacttgggcagggaggcggaggcaggcagcacttcccgggcctctgggggccccagggctgcctatgctgggagaggaatgaaatgtccattccaaacaggtttcccaatgctgccttcccgcctggggtggtggggctagtgtgtaaggcaggagtcatgtcttgggaggaggaggtgccttctgttccactgtttccagcagtgccctgggcatgttctgtgagaccaggccagacctggtagtaggggtccgaggtcacaatttgctctctgctgagacctcagattgagtggtgaggcttgccctagcggctcctttgacatggtcagagttggatcagcacccagcacccacctggccctgttgctccccacagccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtgaaaaaaaaaaaaaaaaaaaaaaactctcgagaacattagttttcttcttcttcctcctttaagagttgaaaccccaagaccgaaacgtttttaagggcccaaaaagggcagtttttgaaagggtttttcccacagcccccacaaaaagagaaaaaagatttccgcaggttttcacccaacttttcggggcggccaaaaacaccttggaatctccggaaaaacgggccccaaattttttcctcggaaaaagccccccccgaggaaaaaacacc

SEQ ID NO: 414538 - DNA, 448 bp, Homo sapiens
ctgcacatgggaaagcaggccgaggagcagcagaagttcggggagcgggtgagctacagcgaggaggggactggggaccaatggcagccttcagtgagatgccggtgtgctcccgctccttacacaccagggggtggccttctctgtctcaccctggccatcaccctgctggaggcctggtgtcttaagtgttgtcccatctgtgcagccctcgtccctcggggtctgaggaggtggggcaggctccctacagagcaggtggctggggcagggtgtggcgccaccttgctgctgttggctggggtggtgcccggctgcctcctgagctgcttgtcatctgatggacaggcagggccgggtgggaggcaggaggagaaagggtccaagcagaggaggacagagcaggctttcctgccaccctccacaggttgcatacttccagagcgcc

SEQ ID NO: 414539 - DNA, 367 bp, Homo sapiens
ttttttggctaggcttcttcaaatcgtgggaataaacacaatctttaaatacataataataacagatatatgactgatatgaacaaaatccttaaaagaccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtacatcgttagaagcttgaatt

SEQ ID NO: 414540 - DNA, 149 bp, Homo sapiens
ccaaatgcacctgtgcagctgcacctcaggttctgctatgaggcagtggtgagacacgtggagcaggtcctgcagcgccatggtgtgcctcctccatgcaaacccttggccagtccaggactgcaaccgccgtcccaaagcacaggggt

SEQ ID NO: 414541 - DNA, 5162 bp, Homo sapiens
cttggggttgcacaccagctcggggtggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggagtgagtgtgggacttgggcagggaggcggaggcaggcagcacttcccgggcctctgggggccccagggctgcctatgctgggagaggaatgaaatgtccattccaaacaggtttcccaatgctgccttcccgcctggggtggtggggctagtgtgtaaggcaggagtcatgtcttgggaggaggaggtgccttctgttccactgtttccagcagtgccctgggcatgttctgtgagaccaggccagacctggtagtaggggtccgaggtcacaatttgctctctgctgagacctcagattgagtggtgaggcttgccctagcggctcctttgacatggtcagagttggatcagcacccagcacccacctggccctgttgctccccacagccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414542 - DNA, 5574 bp, Homo sapiens
tggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaaggtgaggaaggttccgtggaagctgctgggagagccacagccttgggactccctctcctcactcactctgtcttctcagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtgaaaaaaaaaaaaaaaaaaaaaaactctcgagaacattagttttcttcttcttcctcctttaagagttgaaaccccaagaccgaaacgtttttaagggcccaaaaagggcagtttttgaaagggtttttcccacagcccccacaaaaagagaaaaaagatttccgcaggttttcacccaacttttcggggcggccaaaaacaccttggaatctccggaaaaacgggccccaaattttttcctcggaaaaagccccccccgaggaaaaaacacc

SEQ ID NO: 414543 - DNA, 3133 bp, Homo sapiens
tggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacaggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatcctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414544 - DNA, 2724 bp, Homo sapiens
cggacgcgtgggtcgacccacgcgtccgcccagctccggtgtgtaggcaggggctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccagcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 414545 - DNA, 412 bp, Homo sapiens
ctgtcttggcttatctgtccctcagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttgtgagtccactgctctggatggtggttgggggtctaagtgctgtccagtccttggtgctgggagggatgagagcctcaggtcaggcctggctcataggctcttcctggccccatcctgtcccacagaggcctgcccgacagccccagcaacttgctgcgcttcatccaggaggtgcacgcacattacctgcatcagcggccg

SEQ ID NO: 414546 - DNA, 612 bp, Homo sapiens
ggggaaagcggaaacagactgtctgggccgctgttaaaatgtcagcagccaaggaagaagcagcgacctggcgtctgctcgggccaggtgacctttatggcggcgccttctgtccctggtcgcttttccactgaatgaatgaccgaaactgtagtaactcatggccagggaatggcttagttatctgagggaatcttgtctgtgaaaaagggaaactggtgcaaatgggaattcagacaggtcaggaggggaaggaagggaaggattgaggtgggaaaagagagagaaagatgattggcctcttaggggaagaacacacttggacggggctcctggggcacttccttgattccgctgtactcctcagcgggaccggagaggcggaggttccaggagggagccttccagagtcggtgcagggttgacaggagacgtttgttttgcttttcctgaactttcgatcgccagcttgtttggtcttcttgatgttatagggttgatagagaggagtggagtgattgctggagggccctacttgagcatcttgctccactttcctctcaccaccttttcaacattgttgggaaagccctagccaatgtgataagatta

SEQ ID NO: 414547 - DNA, 343 bp, Homo sapiens
catttgctttcctctccactatcccatccgtataagcaaaagagtgtgtgtgatgatgataacaggatcttggatgataagctctatcaactcttgtgctcacacagtatatgcactctgtatcccatattgcaagtccagagccatcaatcattttttctgtgatgttccagctatgttgacgctagcctgcacagacacttgggtctatgagagcacagtgtttttgagcagcaccatctttcttgtgcttcctttcactggtattgcatgttcctatggccgggttctccttgctgtctaccgcatgcactctgcagaagggaggaagaaggcctattca

SEQ ID NO: 414548 - DNA, 4985 bp, Homo sapiens
  misc_feature (110)..(110): n is a, c, g, or t
  misc_feature (4984)..(4984): n is a, c, g, or t
cggggcccggggggcgggggcctgacggccgggccgggcggcggagctgcaagggacagaggcgcggcaggcgcgcggagccagcggagccagctgagcccgagcccagnccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414549 - DNA, 3672 bp, Homo sapiens
  misc_feature (3671)..(3671): n is a, c, g, or t
agagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414550 - DNA, 2541 bp, Homo sapiens
  misc_feature (2540)..(2540): n is a, c, g, or t
gaccctctgcaagtgctcgggccaactctgaccaggctgaccagctgcatcccctgcctctacccacgccaggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414551 - DNA, 1495 bp, Homo sapiens
  misc_feature (1494)..(1494): n is a, c, g, or t
gcacgaggaaaaaagtgggcgggaaaagcataatcttaaaagatttgtaattttctgtatgtgccacatttatgtaaattaactataaaatatggaattcaggatcatgctgttttgcatgtactttataggttatatagcatgaaacatacaaattatcactgttctttagtatatagctccttgctcgtgcggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414552 - DNA, 4183 bp, Homo sapiens
  misc_feature (4182)..(4182): n is a, c, g, or t
agagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtgagcggcagtgggctagggcagaggaggggtcagacaccagcactcccggagcaccttcgtcactggagacatgagacactcccaggccttaccccaatttcatttgcatctgatgccagagggacagtgcgggcaggaaggctgaccagcaggccccagggcccaggccccagacaggtggaggttggggagccacatgactgaccctccctgtgcctccagggagggctgctctgagcaggcagtggatggcagcaaaaggaatctggggccctggcccctctccagccttaagaagagccattctggtggctgaggacagaactaagcgaccatggagtgtgcgccactggcttgctccccacaggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414553 - DNA, 3592 bp, Homo sapiens
  misc_feature (3591)..(3591): n is a, c, g, or t
agagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414554 - DNA, 3459 bp, Homo sapiens
  misc_feature (3458)..(3458): n is a, c, g, or t
agagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414555 - DNA, 3786 bp, Homo sapiens
  misc_feature (3785)..(3785): n is a, c, g, or t
agagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagtgagttgtaaggcgggcaccccacgtgtacccacagccaccagatgaggcctcagccctggcacgtggtcagacatgacaggaggcccagcagtcaccgccttcccctgcaccctcactgggacccatgcagggggcacatcatcattgatggcattgacatcgccaaactgccgctgcacaccctgcgctcacgcctctccatcatcctgcaggaccccgtcctcttcagcggcaccatccgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgccacaggagggccaccctcagctgtggcccccaccgcgggtggtattcccaccatcctgacccgccccctcctgccctgcccagcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414556 - DNA, 955 bp, Homo sapiens
agagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcatatgctgagcgtttccagtgtgggagggacccacaccctgggccaccctggcctcacttgtgcctctgtccacagactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagagggacattggcctgtatggtttcccagctcgccatccctgagcaaggacttgcttacatacctcccaggagaggggactcactgtcactttcacgacaactta

SEQ ID NO: 414557 - DNA, 2268 bp, Homo sapiens
  misc_feature (110)..(110): n is a, c, g, or t
cggggcccggggggcgggggcctgacggccgggccgggcggcggagctgcaagggacagaggcgcggcaggcgcgcggagccagcggagccagctgagcccgagcccagnccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcatatgctgagcgtttccagtgtgggagggacccacaccctgggccaccctggcctcacttgtgcctctgtccacagactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagagggacattggcctgtatggtttcccagctcgccatccctgagcaaggacttgcttacatacctcccaggagaggggactcactgtcactttcacgacaactta

SEQ ID NO: 414558 - DNA, 503 bp, Homo sapiens
gctccctgacagccctctcatttcccttccagtgctgagcgtttccagtgtgggagggacccacaccctgggccaccctggcctcacttgtgcctctgtccacagactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagagggacattggcctgtatggtttcccagctcgccatccctgagcaaggacttgcttacatacctcccaggagaggggactcactgtcactttcacgacaactta

SEQ ID NO: 414559 - DNA, 530 bp, Homo sapiens
tgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgccaactttttttttttttgtactggtaccccaggaggatgccttgtaactgctctttggtcatgatagtggtaatgaatccattcatgtcaaa

SEQ ID NO: 414560 - DNA, 2970 bp, Homo sapiens
  misc_feature (2969)..(2969): n is a, c, g, or t
ggccagtctcccactcccctgctctggaagtgatccaggggctggaatcagtgtcttttggctttcatggaggaggggaagccagagactattcactgggaactggctgcctttctgttctctcctgggcggtgggacacgcctaatgaagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414561 - DNA, 3813 bp, Homo sapiens
  misc_feature (3812)..(3812): n is a, c, g, or t
agagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414562 - DNA, 1485 bp, Homo sapiens
  misc_feature (1484)..(1484): n is a, c, g, or t
ccgacactctggactcccccagctcacacgggctttgtcagggcctccctctctgcgaatggtcaggggctttccctagggcactgccccgagcttcagggcagggacctgggggcagacagcgaggccacccttgtattgagggtgagcccctgcctatggccctggcccagctctcctctcgtttcccactctgtctctttgtctctgtctcactttgctgtggctgtccatgtcattctctgaccttgggatgtacctctgtccctgcctctctcatccttctatgtcactatctgtctccgtattgtaatttctgttggtacccaagtgccaggaagcaacgggatcagaggtggctccattgtagggcggggcacacagacacatccatgcataccactctcagctgcccctgtgtcctcctgccacacccatgcccatagagacacaccactgccccccagctctccttcagccaagtacccggcacacccagacccacaccaaggcccaggcaaatggacatccatgcctgcacttgcgtgccggtccctgtgtaagccctctctggacccactgcaggaaacaagcccaaacctgtggtgtccaaagagaaactagtcagaaaaccaggccaaaaagataccctgtgacctcccacacctgcacacacacccagagctagcatagaggctattcccagcagccccagagtcccagtggcggtgcctgcttctctctttccagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414563 - DNA, 3593 bp, Homo sapiens
  misc_feature (3592)..(3592): n is a, c, g, or t
agagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagtgagttgtaaggcgggcaccccacgtgtacccacagccaccagatgaggcctcagccctggcacgtggtcagacatgacaggaggcccagcagtcaccgccttcccctgcaccctcactgggacccatgcagggatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctana

SEQ ID NO: 414564 - DNA, 1002 bp, Homo sapiens
  misc_feature (28)..(28): n is a, c, g, or t
  misc_feature (46)..(46): n is a, c, g, or t
ccgcctttggaaaagccggggggtcccnaacccctggaacaccacngcacctttaaaaaaaacaggttaaaggccaaaagaacaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaacaatgtgcttgtgttgatgccttacaaaaaccattgtatatttgtgtattccttcttgtatttagacagtggtttttcaggtgcgtgctttgttttctggtatggcctttatggaatgagacgctttagctttggtacgtagcgctaatccatagcagctttggcagtttgctgtcttgagtcttagctaaaaagttagaagtttacatgactgttttttttattttccctaaattattacttactctgagcattaattaagggcattttcacctgtgtaaaattatggtcagcttttttctgtctataattgtttacttttgtgggtttactctagaaacatgagccaaaaatgtcaatagacaacacagtattaaaataacccaaaagttgtaaagggcaacgtttctcccctttgatagggacactaaagtggtctgtacttgggtagaggatggcagacgttaagaattaaaatgcgtctgggtgcagtggctcacgcttgtaatcccagcactttgggaggctgaggcgggcggatcacctgaggtcaggagttcgacaccagcctgatgaacatggagaaaccccatctc

SEQ ID NO: 414565 - DNA, 799 bp, Homo sapiens
tcatcgctgtctggaacagcgatgactcgagggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggtaattgaagttgtgcaaggatcagatgctaaatcttggcagacatccgaggcaccatgtccaa

SEQ ID NO: 414566 - DNA, 484 bp, Homo sapiens
  misc_feature (1)..(1): n is a, c, g, or t
naattcgcggccgcgttcgaacacggtgcgagaagacgacaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgtaagaagctctttgttttgattttgcatactatatgtgaagataatattttatgttcattgtgtgttagactgtgttgaagtggaaactttggaacattg

SEQ ID NO: 414567 - DNA, 514 bp, Homo sapiens
  misc_feature (495)..(495): n is a, c, g, or t
atccttaattaaattaatcttttccccccggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggcatcngaacaggttgaattaagtg

SEQ ID NO: 414568 - DNA, 2342 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaacaatgtgcttgtgttgatgccttacaaaaaccattgtatatttgtgtattccttcttgtatttagacagtggtttttcaggtgcgtgctttgttttctggtatggcctttatggaatgagacgctttagctttggtacgtagcgctaatccatagcagctttggcagtttgctgtcttgagtcttagctaaaaagttagaagtttacatgactgttttttttattttccctaaattattacttactctgagcattaattaagggcattttcacctgtgtaaaattatggtcagcttttttctgtctataattgtttacttttgtgggtttactctagaaacatgagccaaaaatgtcaatagacaacacagtattaaaataacccaaaagttgtaaagggcaacgtttctcccctttgatagggacactaaagtggtctgtacttgggtagaggatggcagacgttaagaattaaaatgcgtctgggtgcagtggctcacgcttgtaatcccagcactttgggaggctgaggcgggcggatcacctgaggtcaggagttcgacaccagcctgatgaacatggagaaaccccatctc

SEQ ID NO: 414569 - DNA, 1833 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1763)..(1763): n is a, c, g, or t
  misc_feature (1769)..(1769): n is a, c, g, or t
  misc_feature (1771)..(1771): n is a, c, g, or t
  misc_feature (1786)..(1786): n is a, c, g, or t
  misc_feature (1788)..(1788): n is a, c, g, or t
  misc_feature (1790)..(1790): n is a, c, g, or t
  misc_feature (1795)..(1795): n is a, c, g, or t
  misc_feature (1798)..(1799): n is a, c, g, or t
  misc_feature (1803)..(1803): n is a, c, g, or t
  misc_feature (1807)..(1807): n is a, c, g, or t
  misc_feature (1816)..(1816): n is a, c, g, or t
  misc_feature (1825)..(1825): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaagaaaaaaaaaaanaacaanancgaaaaaagaagaanananaaaangannaaanaaancaaagaacnagaaacaanaaaacaaa

SEQ ID NO: 414570 - DNA, 1854 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1784)..(1784): n is a, c, g, or t
  misc_feature (1790)..(1790): n is a, c, g, or t
  misc_feature (1792)..(1792): n is a, c, g, or t
  misc_feature (1807)..(1807): n is a, c, g, or t
  misc_feature (1809)..(1809): n is a, c, g, or t
  misc_feature (1811)..(1811): n is a, c, g, or t
  misc_feature (1816)..(1816): n is a, c, g, or t
  misc_feature (1819)..(1820): n is a, c, g, or t
  misc_feature (1824)..(1824): n is a, c, g, or t
  misc_feature (1828)..(1828): n is a, c, g, or t
  misc_feature (1837)..(1837): n is a, c, g, or t
  misc_feature (1846)..(1846): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttccacataaaactttttttctccttttaaatttttccaaaagacagcacaaaaaaagaaaaaaaaaaanaacaanancgaaaaaagaagaanananaaaangannaaanaaancaaagaacnagaaacaanaaaacaaa

SEQ ID NO: 414571 - DNA, 1562 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttag

SEQ ID NO: 414572 - DNA, 2284 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaatatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaacaatgtgcttgtgttgatgccttacaaaaaccattgtatatttgtgtattccttcttgtatttagacagtggtttttcaggtgcgtgctttgttttctggtatggcctttatggaatgagacgctttagctttggtacgtagcgctaatccatagcagctttggcagtttgctgtcttgagtcttagctaaaaagttagaagtttacatgactgttttttttattttccctaaattattacttactctgagcattaattaagggcattttcacctgtgtaaaattatggtcagcttttttctgtctataattgtttacttttgtgggtttactctagaaacatgagccaaaaatgtcaatagacaacacagtattaaaataacccaaaagttgtaaagggcaacgtttctcccctttgatagggacactaaagtggtctgtacttgggtagaggatggcagacgttaagaattaaaatgcgtctgggtgcagtggctcacgcttgtaatcccagcactttgggaggctgaggcgggcggatcacctgaggtcaggagttcgacaccagcctgatgaacatggagaaaccccatctc

SEQ ID NO: 414573 - DNA, 2449 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1926)..(1927): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagtgtgcgcctttgggaaaaaggcacctaacggcgcaggagatagaggcgggctcgaggtgattgaggcttgagggccgggggcggcgcgggctgcgccctgagaaggcggcggtcagtgctttgtgcggggaaagcgcattgcggatggcaattccggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414574 - DNA, 2405 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1882)..(1883): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaaaagtgctgtgaggcccaggcgctctgaaaaatctttgaagacacatgaggatattgtagccctttttcctgttcctgaaggagctccctcagtacaccaccccctcctgacctctagttgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414575 - DNA, 2243 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1720)..(1721): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414576 - DNA, 1020 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaaccatggcaaaaagcaaatttgcctcgga

SEQ ID NO: 414577 - DNA, 1651 bp, Homo sapiens
  misc_feature (1128)..(1129): n is a, c, g, or t
cggacgcgtgggtcgacccacgcgtccggaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414578 - DNA, 960 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgcaggaccaaaactgtataggctttctatgtgttcataaaggtgtagaattgga

SEQ ID NO: 414579 - DNA, 1710 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1187)..(1188): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcataccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414580 - DNA, 1368 bp, Homo sapiens
  misc_feature (845)..(846): n is a, c, g, or t
ggctcttctcatccagaggtgtataagccaacattgctccaattcgtacaaataatctcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414581 - DNA, 808 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggtaattgaagttgtgcaaggatcagatgctaaatcttggcagacatccgaggcaccatgtccaa

SEQ ID NO: 414582 - DNA, 765 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtttgaccgcttaatgcaagcttgctgg

SEQ ID NO: 414583 - DNA, 1398 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (875)..(876): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414584 - DNA, 691 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (650)..(650): n is a, c, g, or t
  misc_feature (660)..(660): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctctnttatcttccngccagattggacataaggtaccagctcgatg

SEQ ID NO: 414585 - DNA, 823 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (458)..(458): n is a, c, g, or t
  misc_feature (460)..(462): n is a, c, g, or t
  misc_feature (465)..(465): n is a, c, g, or t
  misc_feature (473)..(475): n is a, c, g, or t
  misc_feature (481)..(482): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtacgaaaaagaacaaacagaaaacacctggnannnganatggtggnnntaccanngagaccccttattctcctctggagataaagcgccggttttattctactcgtgagaatgacgaaacactaatgaacacgagttgagtttacgtctaaaattcctgtagagcttaaatccagaatcgtagatgactggcacttaattgctaagccaaaacaagtctattatctttcttgcctgagtaatttggaccccaatctatacggatatgctaattaaacaaatgtcatgaaacccagtaataatggggttttagttatgaacataggtatggcttaaaattcttaaattatatcggggcctcattctctttaagtgtagccactctttccaatgctta

SEQ ID NO: 414586 - DNA, 522 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (457)..(457): n is a, c, g, or t
  misc_feature (460)..(460): n is a, c, g, or t
  misc_feature (499)..(499): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtacgaaaaagaacaaacagaaaacaccttnaangccacacccgcccacgcccacgcacacccctgcacccgncgcccaactaaaacccccccccg

SEQ ID NO: 414587 - DNA, 852 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (811)..(811): n is a, c, g, or t
  misc_feature (821)..(821): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagtgtgcgcctttgggaaaaaggcacctaacggcgcaggagatagaggcgggctcgaggtgattgaggcttgagggccgggggcggcgcgggctgcgccctgagaaggcggcggtcagtgctttgtgcggggaaagcgcattgcggatggcaattccggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctctnttatcttccngccagattggacataaggtaccagctcgatg

SEQ ID NO: 414588 - DNA, 500 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcagtaagtttgttttgtgaactgaatattaaggagaaatgcctgtagattaattctggacatggaatgaacaatggagatcatgttggctgccctgcctataaaatgattcctggtacctttcagctgctgtgttacagctttgacttcaagcga

SEQ ID NO: 414589 - DNA, 507 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatggagagggtcagacgtgtggcagtggcttactggggttaagaagcagcagtcccaggggctcagaggctggggcggcctggtatgacacagcaaggaaaaggcctttagaaatgggacaaagtcatgccctgcccccatggatacatccc

SEQ ID NO: 414590 - DNA, 885 bp, Homo sapiens
  misc_feature (13)..(13): n is a, c, g, or t
  misc_feature (34)..(34): n is a, c, g, or t
  misc_feature (58)..(58): n is a, c, g, or t
ttttgtttttttnttatggtgcttaaaagtaaangaaggccgcccattccctcttttntgccaaaaaagtttcaattcccacaatggttttggttatactatagcgcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaacaatgtgcttgtgttgatgccttacaaaaaccattgtatatttgtgtattccttcttgtatttagacagtggtttttcaggtgcgtgctttgttttctggtatggcctttatggaatgagacgctttagctttggtacgtagcgctaatccatagcagctttggcagtttgctgtcttgagtcttagctaaaaagttagaagtttacatgactgttttttttattttccctaaattattacttactctgagcattaattaagggcattttcacctgtgtaaaattatggtcagcttttttctgtctataattgtttacttttgtgggtttactctagaaacatgagccaaaaatgtcaatagacaacacagtattaaaataacccaaaagttgtaaagggcaacgtttctcccctttgatagggacactaaagtggtctgtacttgggtagaggatggcagacgttaagaattaaaatgcgtctgggtgcagtggctcacgcttgtaatcccagcactttgggaggctgaggcgggcggatcacctgaggtcaggagttcgacaccagcctgatgaacatggagaaaccccatctc

SEQ ID NO: 414591 - DNA, 1046 bp, Homo sapiens
ataggctaggtacgaggctgggtggtggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcagtgggttatacacctctggtgggagaaaaagggctttggtttattactcaagttatcctttccggaattcctaaagtaccgggaagatttgggacttggcacggggcagggataatagaagggcctcctgggtaccccggaagcgggtggaagaggactcccactttgttggccccggacaaata

SEQ ID NO: 414592 - DNA, 814 bp, Homo sapiens
  misc_feature (449)..(449): n is a, c, g, or t
  misc_feature (451)..(453): n is a, c, g, or t
  misc_feature (456)..(456): n is a, c, g, or t
  misc_feature (464)..(466): n is a, c, g, or t
  misc_feature (472)..(473): n is a, c, g, or t
tcatcgctgtctggaacagcgatgactcgagggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtacgaaaaagaacaaacagaaaacacctggnannnganatggtggnnntaccanngagaccccttattctcctctggagataaagcgccggttttattctactcgtgagaatgacgaaacactaatgaacacgagttgagtttacgtctaaaattcctgtagagcttaaatccagaatcgtagatgactggcacttaattgctaagccaaaacaagtctattatctttcttgcctgagtaatttggaccccaatctatacggatatgctaattaaacaaatgtcatgaaacccagtaataatggggttttagttatgaacataggtatggcttaaaattcttaaattatatcggggcctcattctctttaagtgtagccactctttccaatgctta

SEQ ID NO: 414593 - DNA, 2288 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1765)..(1766): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414594 - DNA, 2072 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1870)..(1871): n is a, c, g, or t
  misc_feature (2020)..(2020): n is a, c, g, or t
  misc_feature (2044)..(2045): n is a, c, g, or t
  misc_feature (2048)..(2048): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaagaaaaaaagaaaaaaaagaaaaaagaaaagagagagagagagagagagagagagagagagagagagaggtcccaggtgtatggagcgccacatctcctgagattatttgtacgaattggagcatnntggcttatacacctctggatgagaagagccttgctttattactcaattatcttcacgatttcctaaagtacctggcaaagaattcttcaactttgttcagtgccagcgattatgaagtggctcctcctgagtaccatcggaaagctgtntgagaggcactctcactcacttannttnggatcccgtaaacaaatgtggtcc

SEQ ID NO: 414595 - DNA, 2230 bp, Homo sapiens
  misc_feature (1707)..(1708): n is a, c, g, or t
cggacgcgtgggtcgacccacgcgtccgggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414596 - DNA, 2219 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1696)..(1697): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgttttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414597 - DNA, 2349 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1826)..(1827): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagtgtgcgcctttgggaaaaaggcacctaacggcgcaggagatagaggcgggctcgaggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414598 - DNA, 2241 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1718)..(1719): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggaggtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414599 - DNA, 2220 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1697)..(1698): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagttgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414600 - DNA, 1106 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcagtgggttatacacctctggtgggagaaaaagggctttggtttattactcaagttatcctttccggaattcctaaagtaccgggaagatttgggacttggcacggggcagggataatagaagggcctcctgggtaccccggaagcgggtggaagaggactcccactttgttggccccggacaaata

SEQ ID NO: 414601 - DNA, 1809 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (1286)..(1287): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagttacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaannaaaaaaaaaaaaaaaaaaaaagaggggggggcgcagcactaaaaagtacccccagggggggcacaagaatacacgggggtaccaccaggtttcgtctgtggcacaaaggggggcccattagagagggaggcaggtagtaaacgagcacatcgagcagcgtggcgcgcggcaatttataacaaaaacagctgtgtgaagaagtgggggaaaaaacggcgctaataacggtggggagacaactctttggagaagagaggaaacaactatcaactaagtgggggggagggaggagaccacatatatggtggggagaaaaaaatatccacatgagacgggagaattttatcgagaagcatataaaggggagaaaaaatttttttgaagacattttaaaaaaggagacatataataggggggttaaaaaaaaaagaaggaggagatatttagcgagcgaagagagaagaaaaaaaattttggtgagacaagagggacaatgtagcgatgtggggaaaaaaaattgtg

SEQ ID NO: 414602 - DNA, 917 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacatcatattaggagaaaaaaaaagagacagataagaaaagcccttctttaaaagccctagatctactccacgatgatctccggtccggccta

SEQ ID NO: 414603 - DNA, 675 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagcagctctttatctcctgcgagatgtggttc

SEQ ID NO: 414604 - DNA, 571 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (552)..(552): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggcatcngaacaggttgaattaagtg

SEQ ID NO: 414605 - DNA, 775 bp, Homo sapiens
  misc_feature (6)..(6): n is a, c, g, or t
  misc_feature (9)..(11): n is a, c, g, or t
  misc_feature (34)..(34): n is a, c, g, or t
  misc_feature (450)..(451): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtaaaaaaaaaaaaaaaaaaaaannaaaaaaaaaaaaaaaaaaaaactttttggggggcttgggccttggaaaaagtttttaaaacctttggtgggcgacggcggggggcccaagtatggtacgggagaccggggcataagggggtccagaggggaaaactccggggccaatagacaaaggcggtggggagtttcctccacaatttaaaaaaaacggccgcgggggggacgaccgagaccgtgttctgtgaacaaaacccccagaagggagagtcacaggagggacacaaaaagggggattctatcagcaaggggggtcaaagagaacccgagatatcatattatccgg

SEQ ID NO: 414606 - DNA, 424 bp, Homo sapiens
  misc_feature (6)..(6): n is a, c, g, or t
  misc_feature (9)..(11): n is a, c, g, or t
  misc_feature (34)..(34): n is a, c, g, or t
aagganggnnnaagaaaccctatcggctaggtancgaggcggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggtgttttctgtttgttctttttcgttttcacttcaa

SEQ ID NO: 414607 - DNA, 180 bp, Homo sapiens
acattatgctaagagaaataagccaaacacagaaaggcaaatactctgcatgaaatagaaatactgtttaattaggagaatctggttgtgatgcacagagagcattgtctgctagctcattaccttaaatccgacttccatgacacaagactaagaatccaaacttatttgtagatggaa

SEQ ID NO: 414608 - DNA, 2238 bp, Homo sapiens
  misc_feature (2230)..(2232): n is a, c, g, or t
  misc_feature (2234)..(2234): n is a, c, g, or t
  misc_feature (2236)..(2237): n is a, c, g, or t
ggccagagaggagccaggagccatgagggtggcattaggcatgctctggctcttggcccttgcgtggcccccccaggcccggggcttctgcccctctcaatgcagctgcagcctccatatcatgggtgatggcagcaaggccaggacagtagtgtgcaacgaccctgacatgaccctgcccccggcgtccatccccccggacacctccagactgcgcctggagcggacggccatacgcagggttcctggcgaggccttcaggcccctgggccgcctggagcagctgtggctgccttacaacgccctcagcgagctcaacgccctcatgctgcggggtctgcgacgcctgcgggagctgcggctgcccgggaaccgcctggccgccttcccctgggcggcgctcagggacgcccccaagctgcggctgctggacctgcaggccaaccgcctctcggctgtgcccgctgaggccgcgcgcttcctggagaacctcaccttcctcgacctctccagcaaccagctgatgaggctcccgcaggagctcatcgtctcctgggctcacctggagaccggtatctttcctcccggccaccaccccaggcgggtcctagggctacaggacaacccctgggcatgtgactgccgactctatgacctggttcatcttttggatggctgggccccaaacttggccttcattgagactgaactgagatgtgccagcccacgtagcctggccggagtggccttcagccagcttgaactgaggaagtgccagggcccagagctccatccaggagtggccagcatcaggtcccttttgggtggcacagcattgctacgctgtggagctactggagtccctgggcccgagatgagctggaggagggccaatggcaggccccttaacggtacagtgcaccaggaagtctccagtgacggcacgagctggactctgctgggcctgcctgcagtgtcccaccttgactccggagactacatctgccaagccaagaacttcctgggagcctctgaaactgttatctccttgattgtcactgagccgccgacttccacagaacacagtgggagcccaggggcactatgggcaaggacaggtggcggaggggaagctgctgcttacaacaacaagctggtggccaggcatgtcccccagattcccaaacccgctgtcctggccactggaccctctgtgcccagcacaaaggaggagctgacccttgagcacttccagatggatgccctgggagagctctctgatgggcgggcaggaccctcagaggcacgaatggtgaggtctgtgaaggtggtgggggacacttaccacagcgtgtccttggtgtggaaggcaccccaggctaagaacacaactgccttcagtgtcctctacgcggtctttgggcagcacagcatgcggcgggtgattgtgcagcctgggaagaccagagtgaccatcactgggctgttgcccaagaccaagtatgtggcgtgtgtctgtgtgcagggcctggtgccccggaaggagcagtgtgttattttctccaccaatgaagtggtggatgctgagaacactcagcagcttatcaatgtggtggtgatcagtgtggccatcgtcattgccctgcctctcacgctgcttgtctgctgcagtgctcttcagaagcgctgccgaaagtgcttcaacaaggactccactgaggccacagttacctacgtcaacctagagagactgggctacagcgaggacggcttggaggagctgtcccggcacagtgtcagcgaggctgacaggcttctctcagctcgttccagtgtggactttcaggcctttggagtcaaagggggcaggagaatcaatgagtacttctgctgagggatatgcctccgcaactcacacacctgcctgcccacgctccttctttagctctgacacctgagtacacgatcacccactcttacctgctcgggtacctgcttactcagatacttacacacaacaacagcagcagcaagctgctactgcaacaaccgctaacacttgttaagcacttactacagactagaaagtgttctaagtgctaaattcttgtaacaatcatttgcagcaggcatcactattctctccatttccctggggtggggggttaagaaacttgcctgtatcagtcagcttttgctgtataacaaatgaaagcaaaatcttggtgannnananna

SEQ ID NO: 414609 - DNA, 2058 bp, Homo sapiens
tggtccccccaacagatctttgggggcagcctctatgggacaagagtgacacagggctggagaagaggagtgaggagcctccttgtgtctgatgcacagatgtggccctttcaaaccctggtgtcaccctctgggtgactggatccccagctccagcctcttcctgggccagccaggaaggctggaggaaagctctttgctgagtgcatgcatgggagtgtggggggtgactgagccctccccatgcaaggggcttggcctgggaccctggaagctgtttcccagatggggcccttgctgcgtgacggggtctccatgcgctttatttatttgcagtctgttttctaggcggtggagctagacactgaccggaatgacatacttttctgtgtgtgattcactgtgtactggtcagcacaggctggccagagagctgttcttgtttctggtgttgtcacgtcttcttgttttctctaagtttaaaaaaaagtccttggtttaatacactaaaatcccaactggaggcctcccgtgtctggtgggggtgatgcagtggccccgggtggagaggccccatggtgaggtcaccagctcccatggccaggagttggcagggagaagcctctgagggctagggctgggggaggctgtggcagggaccgtgtttcctgttcagaggctgtgctgagaaccgacttgacctggaccactgccccatgagaagcaggcagcatcctagcctggccccgagaggtagctgcttgttctgttgacaacctttgttcaacgacccaaaacataagtccctttcctttttagagtctggcgatcaaaagtgtcttaagtcagtagaatcctgagggtggactagggtgaagtgaactgaaacagactcgacacaggtcattttgtgtagcactgagactcctctccctgcctgaggccacctcccactgcctccctaccagcaaggttactgcagaatcttggagaagataaaggacctggccctggaagcctgcttccctttcccaaccttggaagcaaattctgtcccatcagagcccccctccctagtggctcccaccagagacctccctagtggctgctgtaagggttggcaagcaggcaaaaggcgggggagggagggcagagggtagtgttagaggaagccccatagggcccctgggtgggggtggggaggcatcctgaggacacagggctatgctcagacttaggagtgaagactgggtttaggggccctgggggcactcctgttgccaagggctacccaggggtcagagcatcctgacaaggaggacccgtccaaacgcactggtgctaatgccctatggcatctgccaccacaggagaaatggaccccagtccttgatcttccctcccctttgtctagatggtcctctttatccccactccagggatcacatgacttggcaaagcaagatgggaaatgatcctcccagagcctggctccaaggcttcttgaagagggaggatcacccctcccatccctgctacagaggaaaaggcaggaaggccggttctgctccgatgggactccaggagaccaaagccctgagccctgagcccagctcttccacttactactgtgtggtgccaggcaagctgtgcacaacctggagtttttagtaaggttccgttgggatgcttgtaagcagtgaatacgatgatgtctgttcattgtttgtcatcaggtctcacctggagcagccttgttactgtggggaaaaggaaccaagtgaagggaatcggcctctgatgagagcctgccatgtgccaggcaccatactaggtgctttgcattcctaatctcatcattatcacacaaccacctaaccattatccctgttttacagagaaaccaaagacaggaaccaagtctgaaacagagccccaagaagaagctcttttcctgagctaccagtgccccttggagaggcagggaattgggctggaagaatggtggaatggaatagcaaagatggaagatgaccctgtcctttctgggtgaggtcc

SEQ ID NO: 414610 - DNA, 2330 bp, Homo sapiens
tggtccccccaacagatctttgggggcagcctctatgggacaagagtgacacagggctggagaagaggagtgaggagcctccttgtgtctgatgcacagatgtggccctttcaaaccctggtgtcaccctctgggtgactggatccccagctccagcctcttcctgggccagccaggaaggctggaggaaagctctttgctgagtgcatgcatgggagtgtggggggtgactgagccctccccatgcaaggggcttggcctgggaccctggaagctgtttccctactgggataaagttgcgtcagccgcaggggtctctgccctcaaagaccccccactgcagggagccccaccccataagagggtcacggaagtccatgtccgcccacccccagtggcttctggtgtggccgtattggcctagaggggctgactggggagggtcagggccaagccctcagcatctgctcctgtccctgctttttcacccctgctgcctgaagtggtagccccgcctgctgcttctccacctcccctccccacctcttctctcccagatggggcccttgctgcgtgacggggtctccatgcgctttatttatttgcagtctgttttctaggcggtggagctagacactgaccggaatgacatacttttctgtgtgtgattcactgtgtactggtcagcacaggctggccagagagctgttcttgtttctggtgttgtcacgtcttcttgttttctctaagtttaaaaaaaagtccttggtttaatacactaaaatcccaactggaggcctcccgtgtctggtgggggtgatgcagtggccccgggtggagaggccccatggtgaggtcaccagctcccatggccaggagttggcagggagaagcctctgagggctagggctgggggaggctgtggcagggaccgtgtttcctgttcagaggctgtgctgagaaccgacttgacctggaccactgccccatgagaagcaggcagcatcctagcctggccccgagaggtagctgcttgttctgttgacaacctttgttcaacgacccaaaacataagtccctttcctttttagagtctggcgatcaaaagtgtcttaagtcagtagaatcctgagggtggactagggtgaagtgaactgaaacagactcgacacaggtcattttgtgtagcactgagactcctctccctgcctgaggccacctcccactgcctccctaccagcaaggttactgcagaatcttggagaagataaaggacctggccctggaagcctgcttccctttcccaaccttggaagcaaattctgtcccatcagagcccccctccctagtggctcccaccagagacctccctagtggctgctgtaagggttggcaagcaggcaaaaggcgggggagggagggcagagggtagtgttagaggaagccccatagggcccctgggtgggggtggggaggcatcctgaggacacagggctatgctcagacttaggagtgaagactgggtttaggggccctgggggcactcctgttgccaagggctacccaggggtcagagcatcctgacaaggaggacccgtccaaacgcactggtgctaatgccctatggcatctgccaccacaggagaaatggaccccagtccttgatcttccctcccctttgtctagatggtcctctttatccccactccagggatcacatgacttggcaaagcaagatgggaaatgatcctcccagagcctggctccaaggcttcttgaagagggaggatcacccctcccatccctgctacagaggaaaaggcaggaaggccggttctgctccgatgggactccaggagaccaaagccctgagccctgagcccagctcttccacttactactgtgtggtgccaggcaagctgtgcacaacctggagtttttagtaaggttccgttgggatgcttgtaagcagtgaatacgatgatgtctgttcattgtttgtcatcaggtctcacctggagcagccttgttactgtggggaaaaggaaccaagtgaagggaatcggcctctgatgagagcctgccatgtgccaggcaccatactaggtgctttgcattcctaatctcatcattatcacacaaccacctaaccattatccctgttttacagagaaaccaaagacaggaaccaagtctgaaacagagccccaagaagaagctcttttcctgagctaccagtgccccttggagaggcagggaattgggctggaagaatggtggaatggaatagcaaagatggaagatgaccctgtcctttctgggtgaggtcc

SEQ ID NO: 414611 - DNA, 238 bp, Homo sapiens
tcacttgttcagggtctgtttctaggtgaacccaacctgcaacacttgaccagcaagatttctagtttgtctcctcaaatggccccactgatttgtaactttttagtgcctataatttttaggttcagatcacatttggggtcattttaaaggatttctgtcttattcagccaccccagcggctcagtgttgggtgtattgggaagcctcttggatagaaggaggggacttttgtaca

SEQ ID NO: 414612 - DNA, 894 bp, Homo sapiens
tgtccccaccatgtgcttggttctcagctagaagtagaagaaataaagacaggcttgtgttaatatagcctagtgtaagtagcatgatagaattagctcagagtgtgcaaccttgagggagaagactctgacctgtaactgagcagctgccgtggttgggggtggttattggaggaggaggagaaagaaagacagctcagggaaaacatcctctcctggaaaagtgttaaagtgaatgcatacctgaaccaagcctcaaatggtgagtaagatttccggaagcaagggaatacatgggtcatattcaaggaactgaaagatggttggaagagttcagtataactagagccagggcatgagggctgtggatggagtttgggagatttactttgggagttgtctccgtgttttatataggttatagatgttgtcgaaaaaatagaaaatatgagtcagctgaaacaacaatcatacatgtaccactcagatacattgctgagtttttccttcacctgtatcatttttgcaaaattggatcacagtaggttagctattttgtaacctgcttttttttttaatggtgaaaaacatatatatttagaatttgccagctggattcaacttagatgatcccaattttttggcagcctctaaaagcagcatgctcaggagccagctgaacatgggctttcttctctccatcagccctgatcacggtgttgatcttggccacattggtgtcatagagctcctccacagcctgtttgatcttatgctttttgacctcgacatccacaatgaacacaagtgcattgttgtcctctgtcttcttcatggccaagtcagtggcctgggagaacttgttggtcgcatagtggtcaggcctgggggaga

SEQ ID NO: 414613 - DNA, 436 bp, Homo sapiens
aggagaggaggcaaaaagaagaggaagcagcaagactggctctggaagaagccacgaaacaagcccaggaacaagccaggcaaaaagctgctttggagaaacattttcatttctatcaagaactccataaggaagccagtggcctgcagtggacacagaacatttccagaccatgggtttactcttatttccagttcctacaaatacccaggccttaaggctagaagaaaactaaaaaatttaggatgttgcagtcaagcaccagataagagtgacttccctaaatgttattcaaggtcccttcagaaatctgataatctgttaaaatttttgttgtgaaatgcctattttatcagcactgctaaccagataagcacacatttaagttaaccatatcagagtgcaatgcatttcgaaaaatccaaaaaactaaaaa

SEQ ID NO: 414614 - DNA, 884 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcaaagcccgttttggcctgagtgcggctgaggacatcaccccccggttcagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggcaacaaatgcaaaaacaataaaaaacagggg

SEQ ID NO: 414615 - DNA, 907 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcaaagcccgttttggcctgagtgcggctgaggacatcaccccccggttcagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggcaaaaaaaaaaacaaaaaaaaaaaaatagaaaaacaaaaaaaaaaaaaaaaaaa

SEQ ID NO: 414616 - DNA, 1209 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctctggggtcgggcaggtttcgggtgcccccagtgggcctcgggttccaggcagctcgtgacaagcccctgtgctctctagaaagcccgttttggcctgagtgcggctgaggacatcaccccccggttcaggtgagacccaagcagggaggaaggacgggtggggaggaggagggtctgccacagctctccgcacctctcctctcccagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggcaaaaaaaaaaacaaaaaaaaaaaaatagaaaaacaaaaaaaaaaaaaaaaaaa

SEQ ID NO: 414617 - DNA, 816 bp, Homo sapiens
acggctaggtacgaggctgggtttatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggcaaaaaaaaaaacaaaaaaaaaaaaatagaaaaacaaaaaaaaaaaaaaaaaaa

SEQ ID NO: 414618 - DNA, 924 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctaaaagcccgttttggcctgagtgcggctgaggacatcaccccccggttcaggtgagacccaagcagggaggaaggacgggtggggaggaggagggtctgccacagctctccgcacctctcctctcccagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggcaaaaaaaaaaacaaaaaaaaaaaaatagaaaaacaaaaaaaaaaaaaaaaaaa

SEQ ID NO: 414619 - DNA, 985 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcaaagcccgttttggcctgagtgcggctgaggacatcaccccccggttcaggtgagacccaagcagggaggaaggacgggtggggaggaggagggtctgccacagctctccgcacctctcctctcccagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggcaaaaaaaaaaacaaaaaaaaaaaaatagaaaaacaaaaaaaaaaaaaaaaaaa

SEQ ID NO: 414620 - DNA, 828 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcaaagcccgttttggcctgagtgcggctgaggacatcaccccccggttcagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccaccttcttcttcctcctcctcttcctccccaccttactcagacatctggtacca

SEQ ID NO: 414621 - DNA, 995 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcaaagcccgttttggcctgagtgcggctgaggacatcaccccccggttcagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaataaccgtccttgggtcggaaaaaaacacaccacacacacacaaaaaaaaaccccggcgtttttgcgggggcgaaaggataaaggacaggtacttttccgccccttttcaggggtatcccgccccttttggtaattaacttctcatatcatatactatataggtaag

SEQ ID NO: 414622 - DNA, 1131 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctctggggtcgggcaggtttcgggtgcccccagtgggcctcgggttccaggcagctcgtgacaagcccctgtgctctctagaaagcccgttttggcctgagtgcggctgaggacatcaccccccggttcagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggcaaaaaaaaaaacaaaaaaaaaaaaatagaaaaacaaaaaaaaaaaaaaaaaaa

SEQ ID NO: 414623 - DNA, 1299 bp, Homo sapiens
cactaggctaggtacgaggcggtggtaatcggcacgaggcgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctctggggtcgggcaggtttcgggtgcccccagtgggcctcgggttccaggcagctcgtgacaagcccctgtgctctctagaaagcccgttttggcctgagtgcggctgaggacatcaccccccggttcagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccaggtaaggcatgtccgcctgtgactcaagtagggctgtgctctttaacctggaactcagtttccccccaaacaagactcacgctccagagagaatgcctatctattcggagaaggttgtggttgggatgctgccaggttcaggagctgcccctgtcctgttttcccccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggcaaaaaaaaaaacaaaaaaaaaaaaatagaaaaacaaaaaaaaaaaaaaaaaaa

SEQ ID NO: 414624 - DNA, 399 bp, Homo sapiens
ttgtgtcactgatacatttctgaaaacacaagaagattccctcctactatttctccacttaaaatacttaatactgaaaagctgagtgtcattggttgttgaatttctgctggagttggcgagatgactgttaacactctaaaattaggggcttcgctttccctcgggcttatgagaatggtttaaatataatagatactcagtaaatatttattgattgatacacagctttgggatcccaagtcaggatctgcctctactcagtctaataatgccctttggggagaaacatttttcattacagatttctcttaattgtaagaaatctttaattctgaaaggttaaaaaaaaagttcagttcagtcgttctttaaatcttttgggtcataggaaccttt

SEQ ID NO: 414625 - DNA, 451 bp, Homo sapiens
caacatgccgagccctagagtggtcctccctctcccaccaccaactatcctacctggcctcccaagaactgcctttggtgactcttgtattctctgtcttgcttcatgcctgggaaatttcagggcatatattaaggggaaaaccttagggaaacctgaaccttcaaaactgggtagaatgaatggatggaatggaagaatttactgcagcgaaatcatcttcaaattccttttaggttggaagcttcttaccctggcaagtgaagaagtacatttggttatatgtttataatccatgtgctactgggtgaaagatgataggacaagaacatttgaaatgtatgtgttagggatctctgcccagcagtttccatcaaaagagcacacccatgattatcgtacaaatggatgggacagcaggattctactcacgtaaaatgtttgtccctga

SEQ ID NO: 414626 - DNA, 4064 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttttttgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414627 - DNA, 417 bp, Homo sapiens
gactagttctagatcgcgagcgcccacgcgtccgcggacgcgtgggtcgcccacgcgtctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414628 - DNA, 3928 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttttttgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414629 - DNA, 4198 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttttttgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaataaaacaaacacactcatcaaaaacaaacactttgtcggggcgcccgggccccaaaaaagtttaaacacctcggggggggggggcccaaggtaggaactgggcacacgggttcacgagaacccgcggacgaaag

SEQ ID NO: 414630 - DNA, 2284 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactactggtgttctgtttcaatgtataaggactatagtgatttaaactcatcaatgtgcctttgcataaagttgattaaataaatattgatgtggtataaatgcccatcagatatgcttaaacttggttttcagttgaatgaagtagagaatgtcctcaggaccatcagcattttaaaggttatgtgacttttgctgatttctctgagttcaagttaagcatgaagttagtacctcaagcctgtgatttttccctagggatgatacagacccaagaggctacaacagaacttaaactggcttcgtaattagagtttttaagataattgtttgtttttcagcaatatagactgaaaagatccaagcatatttagccactttgcatccagaggacactttgcatccagaggacactttgcatccagagacactttgcatccagagacacttggcatccagagacactttgcatccagagacactttgcatccagagacactttgcat

SEQ ID NO: 414631 - DNA, 3847 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttttttgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtacctgcccgggcggccgctcgaaa

SEQ ID NO: 414632 - DNA, 1891 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactaaaaagaaaaagaacctaaacagtattttatagacatatgttagaaaagtcctagaaatgcgcccaatttccttccattgtactttcctacatggcatgaagttagccc

SEQ ID NO: 414633 - DNA, 1847 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactaaacacaacacacacaccaaacacacacacaacacacaaaccacaacagcaacaaccaaacaaaa

SEQ ID NO: 414634 - DNA, 2786 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttttttgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggattgcaggcgtgagccactgctcctggtctatctatttatttctcttttcccatgtactcttcctggaaaggtttgtagcactcgggatccctcggatccaggatgctcaacctatgcgtacattttcactgatagtggaaacagtttctaaagtggcatttgttaccttgccccaagcttaatgtagtgttccatctcactcgcagcataccagtccagtccctcccagttcccgcggggaacccacgcactgacttgcgctctcgatcgcaccacccgacgctcctgggccatcagcggtctctgggagacgccaacggggggccgcccggacatccccggtccgagtgacaactgaggacttccgaccagata

SEQ ID NO: 414635 - DNA, 1775 bp, Homo sapiens
  misc_feature (1772)..(1772): n is a, c, g, or t
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaactttttgacggatttgtcctgctccttttgctctttttttgtgtgtggnggg

SEQ ID NO: 414636 - DNA, 3439 bp, Homo sapiens
attcatgagaccgttgagcatattatcacgggaaagaagatgtggcacactctgggagttcttgtacagctttgtccaaatggcacaggggcacaaatagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttttttgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414637 - DNA, 2865 bp, Homo sapiens
catggctgactctatgaggaaccccgcccttcgctgggtaatgtgacacagggaaagtattcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttttttgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414638 - DNA, 2386 bp, Homo sapiens
attctagaaaagacacatttacctacagtgaaaactactcagtgtttgcctagggattctgggggaaggcgagcactgagagaaaggttaagggcctcaggttaactttgggggtaacagatatgtccaataccactgatagggtgatagtttcatgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414639 - DNA, 2295 bp, Homo sapiens
caatatgattaattagtaacttactagaaaccaggtcatcaagcggaatctggtcccagaaagatgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414640 - DNA, 2293 bp, Homo sapiens
tcccgttacctgggcatttttgatagcagaggtcaccggggatagtggtgtgtgtgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414641 - DNA, 1724 bp, Homo sapiens
agtggaggtcattctgtgaatgaggcagtttctacagaagggggactctgtgactagtgagtcatacccaaagatgaatgcaatgatggaatgatctcattttaaaaagagcaactgtccaaagctattagctaagtattagacagttattagaaaactcaaactggaatcagtctctgagccttgattaaacttctggtggctgggccgggtggctcacacctgtaatcggagcactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414642 - DNA, 1467 bp, Homo sapiens
gctcggattacaggcatgagccaccgctcctgctgaaacttttcttttttttcagacagagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414643 - DNA, 899 bp, Homo sapiens
  misc_feature (817)..(817): n is a, c, g, or t
  misc_feature (878)..(878): n is a, c, g, or t
  misc_feature (882)..(882): n is a, c, g, or t
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaaacaaccctaactcccaaangggaaaaaaacccaagaaagcctggggaaaccctaattcaaagtttaaataaaatgggggnaaantggataaacctttgtcc

SEQ ID NO: 414644 - DNA, 2788 bp, Homo sapiens
acacaggaaatgggaaatagaaatagcagttaacttctttcctgcaagtgtatccatctgtagcattccttcctcctctccagtctcagagtaggttttcttttcctggttaaactgaggcaaacagttatgtcatcaaggcccatttatatctcttttcccattactaagtgaccccagattgttatgtattgagttcttaatgtcttacgcttttggaattcaatctcttaacttgtaggagaacttgtaccattcagcatcttctgtcaattgctaatggctgtttccctcatcctatttaagttcttctaaccttaagctatcctttcttgtccctatgtcccccttctaattacctcccttttgtcctgccttaatcattctaaacttctcaaaatgagtattgtatttgttaccctgcccaagttcttgatgtcctaaccaatcacttcccattccctcttaaacctgcagcaattttactcatatctcccacccttcatattgctagaggcaatggacatgtttcaaagctttctactattatttgctgtctttccaccttaattgaaacgttccatccttagcttctctggcgccattttctatctgcccttttacatctttttcctactccattgtctatcccacaggtattggtgttcccaagggtttttgtctctgatcctctttttattctacttccccttactgagaaatgttcttgcccatgttttaactaccacttaggttcatatagccacttggttaggacatagtgattttttttttttttgagatgggttctcgatatgctgcccaggctggtcttgaactcctgggctcaaacagttctcccatctcagcttcccaagtagctaggactacaggcgtaagctaccatgctcaactaaggacacagatatcttaaactcacatatctaaaactgagcatctctctcttccacgtatcctttttaccacctgttccatataactacaaaaaactgaaatgcatatattcttcctcttttatagaatggcaccagcatctacataatcagtcaagtgtggaattggaaaccattctattatctcctcctcgtacaccccctacatccgtttggtcaattttgccttctaatttgatctccagtctgtgccttctgcttttcttctgcacttcattaatccagctcaggacaatattattggttacctggactctagtgataaagatatgtcctaccttactacctccatctgccataacttctgaaatgaaatcctgcttaatatcctgctgctgaatttttttttcatcaggataaggccagactacctaagagcatatagtacctttgtgacctgggtccctgcacactttttctgccttctatccagccaaaaataccttttgatccattgttctagctctgccaacctgcttgcgtttcccttgaagtgctatgtctttttactctccatatttttgtctgtgctatttcttatacctggaatgcccttcccccattacttgcatcattaattcctattcattcttaaaatctcagctcaagtgtcaccttttcaaagtgtgtcttatgtaataaggctgaacttgagtgtgcctctgaaatttttccatggcactttgtgttgcctactcctaccacaacacattttgaaattataaccactgatttttcttgtctgactctaacactagactgagcatcttgaggcaaacagttatgtcatcagggcccacttatatctcttatatctcttttcccattagtaaatgatcccagattgtaatgtattgagttcttatgtctgctttgtatagttgttcattcagtgagttaatacttaacagcaatatttgaagcattgtgcttcttcgacatcataacagtttgcctctgaaagctcacggcctgatcatcaaggcaaggctaattagatttgttcattatgttctgtttaagaaatctgggaactatgtgaccatgttatacatttttcatccaaaatgactgcatttttacttggtacttaaaagtgtattatttggttatttggaaaatcacttttgtggaacatctcatttgctgataatgaaatgccaatgacttgttaccttggtataaaaaaccaaaatatgcgtgttaggaagtgctgtcattttactcaaaatacacagatttgaaagtttgtcactgtttctgttctcaattgtcctttctccacatctagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcacta

SEQ ID NO: 414645 - DNA, 2583 bp, Homo sapiens
acacaggaaatgggaaatagaaatagcagttaacttctttcctgcaagtgtatccatctgtagcattccttcctcctctccagtctcagagtaggttttcttttcctggttaaactgaggcaaacagttatgtcatcaaggcccatttatatctcttttcccattactaagtgaccccagattgttatgtattgagttcttaatgtcttacgcttttggaattcaatctcttaacttgtaggagaacttgtaccattcagcatcttctgtcaattgctaatggctgtttccctcatcctatttaagttcttctaaccttaagctatcctttcttgtccctatgtcccccttctaattacctcccttttgtcctgccttaatcattctaaacttctcaaaatgagtattgtatttgttaccctgcccaagttcttgatgtcctaaccaatcacttcccattccctcttaaacctgcagcaattttactcatatctcccacccttcatattgctagaggcaatggacatgtttcaaagctttctactattatttgctgtctttccaccttaattgaaacgttccatccttagcttctctggcgccattttctatctgcccttttacatctttttcctactccattgtctatcccacaggtattggtgttcccaagggtttttgtctctgatcctctttttattctacttccccttactgagaaatgttcttgcccatgttttaactaccacttaggttcatatagccacttggttaggacatagtgattttttttttttttgagatgggttctcgatatgctgcccaggctggtcttgaactcctgggctcaaacagttctcccatctcagcttcccaagtagctaggactacaggcgtaagctaccatgctcaactaaggacacagatatcttaaactcacatatctaaaactgagcatctctctcttccacgtatcctttttaccacctgttccatataactacaaaaaactgaaatgcatatattcttcctcttttatagaatggcaccagcatctacataatcagtcaagtgtggaattggaaaccattctattatctcctcctcgtacaccccctacatccgtttggtcaattttgccttctaatttgatctccagtctgtgccttctgcttttcttctgcacttcattaatccagctcaggacaatattattggttacctggactctagtgataaagatatgtcctaccttactacctccatctgccataacttctgaaatgaaatcctgcttaatatcctgctgctgaatttttttttcatcaggataaggccagactacctaagagcatatagtacctttgtgacctgggtccctgcacactttttctgccttctatccagccaaaaataccttttgatccattgttctagctctgccaacctgcttgcgtttcccttgaagtgctatgtctttttactctccatatttttgtctgtgctatttcttatacctggaatgcccttcccccattacttgcatcattaattcctattcattcttaaaatctcagctcaagtgtcaccttttcaaagtgtgtcttatgtaataaggctgaacttgagtgtgcctctgaaatttttccatggcactttgtgttgcctactcctaccacaacacattttgaaattataaccactgatttttcttgtctgactctaacactagactgagcatcttgaggcaaacagttatgtcatcagggcccacttatatctcttatatctcttttcccattagtaaatgatcccagattgtaatgtattgagttcttatgtctgctttgtatagttgttcattcagtgagttaatacttaacagcaatatttgaagcattgtgcttcttcgacatcataacagtttgcctctgaaagctcacggcctgatcatcaaggcaaggctaattagatttgttcattatgttctgtttaagaaatctgggaactatgtgaccatgttatacatttttcatccaaaatgactgcatttttacttggtacttaaaagtgtattatttggttatttggaaaatcacttttgtggaacatctcatttgctgataatgaaatgccaatgacttgttaccttggtataaaaaaccaaaatatgcgtgttaggaagtgctgtcattttactcaaaatacacagatttgaaagtttgtcactgtttctgttctcaattgtcctttctccacatctagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagctta

SEQ ID NO: 414646 - DNA, 441 bp, Homo sapiens
ggcacaaactgcaattacttttgcaccaacctaacactaaaatctccccctttttgacatctcctcttaattcctttgccttcttattttctttttgttaaggtcctcactacttacaacctaattttttaaaaaatcagtttaagaacagcagctcaagccagttttccttttctttttagacatacacgaatttatccagaggagtggtatgtagcagaagaatcagggactggtttacacagcaaaccaggcaaagggcaacctggccatggagaatgtatgatttaggctgaagtggcatgccctacataaatgcttggtgttccttgctgcctgtttgtttctcacccccaaatttctatttcttttagaaaactgtaaccatttcagaccatggcactgtgacatataatggaagcatttgtggggatgatcaga

SEQ ID NO: 414647 - DNA, 497 bp, Homo sapiens
gattttttgttctacgctgaagttgattttgtttggtagagtgtaaggctttgctggccacttttatagctaacctgtaccttttccctttcttcttctcctgaaggttgcttcagttattaacatcaaccccaatacaactcactccacaggcagctgccgttctcacactgctctacttagactcaatagcagcaccattaagtatctagactttgtctttgctgtggtgagtaacagattttttaaagttaggttcattctcttagaaacacatctgaaagtctaaatagttgcatggggggaggggggtatttagctttattttccagttctacagtactcaattataaagtgtagtccattcatccctgttcatccctcagagtctgtgcaatggtctgtggactggactcttgcattaatgttcaccaagagtggccattttaccattagagagactctagggtagaagcaagaattaactcacatcaaaa

SEQ ID NO: 414648 - DNA, 487 bp, Homo sapiens
cacactttttctcacctaccccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaac

SEQ ID NO: 414649 - DNA, 916 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacatgtggcatttctaattaaaaaactatccagggaaaccgaaggtgaactattagctatatggaagaaactgtccgggccccagggggccaggaaaacccgaaagggggcgttttaataaccccaaaatcccccagcaaggcgc

SEQ ID NO: 414650 - DNA, 4224 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttttttgtgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaaaagaaaaaacaaaaaaaaggaacccccagaaaccacaacccaaacagggggcgcaccccaaggaggacccccacggggcccccacaaggggacacccgcccggggtcaagggggcccaagggggccacacaggggggcggggggggcccacggcggaccg

SEQ ID NO: 414651 - DNA, 3430 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactactggtgttctgtttcaatgtataaggactatagtgatttaaactcatcaatgtgcctttgcataaagttgattaaataaatattgatgtggtataaatgcccatcagatatgcttaaacttggttttcagttgaatgaagtagagaatgtcctcaggaccatcagcattttaaaggttatgtgacttttgctgatttctctgagttcaagttaagcatgaagttagtacctcaagcctgtgatttttccctagggatgatacagacccaagaggctacaacagaacttaaactggcttcgtaattagagtttttaagataattgtttgtttttcagcaatatagactgaaaagatccaagcatatttagccacttgcttttttgtttcttgttttgttcttctttggatgcctgattagtattgaaagatagaaatattctatgaactaattaggacagattgtgttgtgtttctctacctcatcttgttgatctctggagcattaaaatctatttagtgttgtcatcagtgtggtacttatgaaatgtaagctaacagcaatctcagaagggaggcagtgaagcatagcaactaggctcttgtttcttcaagatggcccctgtggggcagtgcatagatgggggtgtaaagagaagctgttggcattaaaatgagctagataatcagcccttgttgaagcatattccatggtataagagtagcacagacatgaaacatagataaagaaggaaggcttaatagactagaagacttccacattgaagtattattaacccattgtatgtatataggggcatgatcagagtctctataacttcctgattaacaatacagtgtatcttgttacccagctgtcagtctttgagagctttcagtaaaatatagtaaattctttcagcataggctaatgtgtggttactgagatgagtgttgtgtactcagaaccgtagcaacatttttatgaatggtaaaagtacaagaggaggaaaagttaaaattagaagaaaagtacaagttattgcttaatcataaatcacaccagataacacattttgttaatttcattagctattactggaaaggaccttaacgattatttacagaaaggggagtgaaattcattgaggttccatatcaagtgggcaacaaaactattactagcattttgataaaaattgcccctaatgaaatctagtcactcaacagtaaaacaacagctggtttacacttgaaattatgagatcagaattgggcactttgggcttccgtactatgttttgcttaagttttttttttaatactaatatgggctttttcagtagtaatataccaaaacacttctattttaatctctgtttgctacttcaaaacctaatcctcctcagatgggatcatgagcataagaggaaaagagaagagaatgaatacttgttgacctcttgatgtgtatcagatgctttagaaatgtaattgtatttaatcctcaaataccttataggtattattatccccttcttacagatgaggaaagtgaggcccagtttaaataacttgcccaaggtcctttggctagtactggaaggagtcaagatttaaacacagttctgtctgaatccagaactcaa

SEQ ID NO: 414652 - DNA, 1783 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcacta

SEQ ID NO: 414653 - DNA, 1578 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagctta

SEQ ID NO: 414654 - DNA, 1728 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 414655 - DNA, 1457 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggataattcttttatcaatcccagcattttgagatcagtctttattaataaaacctgttctctttaatcagctta

SEQ ID NO: 414656 - DNA, 1117 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggtataggtgtctatctttatcaatacatcctttttgcatttcatttcaaatattgcgtatcctaccttcagcccaaaggtagtgttactagaatgattccgttttctttttgtttgtttgtttgtttttttgagatggagtcacgctctgtcccccaggctggagtgcagtggtgcgatctcagctcactgcaaactccgcctcccggg

SEQ ID NO: 414657 - DNA, 797 bp, Homo sapiens
cccctagtcttagtgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatggagtcccgtgtgctaagacaaactcacaggggccacaataaaccagtgccttcctaaaaccactccagaaacca

SEQ ID NO: 414658 - DNA, 468 bp, Homo sapiens
ccccatcaaatgacttggccaaggtcatttgatgggggctgtcatacggcactaacaggtagcgaggtgtggaccaagagactgcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414659 - DNA, 441 bp, Homo sapiens
  misc_feature (161)..(161): n is a, c, g, or t
  misc_feature (221)..(221): n is a, c, g, or t
accccagtgcccatggaaacagagctcctgcttttccccccaggaaggcgttgatacatttataggctagcattcaacatcagcgttgtgctctggcagtctcagcagtaagacataaacctaccaaggtctgggggaagcactgggtgttaccaccctgntcacgcgggagacgcatgctcctccgtgactgtttgtggccagtgagccaccagttgacnccagcaatccagccttctgcccctctcacttcacagatgagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414660 - DNA, 490 bp, Homo sapiens
gggctcccttctctttgctctggtggagcagagcttctgaaaagacatccttgagggttcagtgtcactcccccttcagccccctgcatgtctctgactgcctggagctcctttctcttctggggaagtcgtgagcccaagcagggctgtagaggcaggtcattcggtactgggccatcttttgtcccatttctatgattaccgtgacaagggaagtctcgagcttggctgcagccaggatgctgtcttgttatcacgttgcttcataaagaagaatacttggttattcagaatgaaatgctgggaacagaatatctgaatccacatcagtggtctcagaatcactttgttctctggaacatcatagcacatttcttgagaaatacagaaccacatttttgagcttagatctgtcctcggtctcctacaatggttttgtgtgttttagactccagctgacattggagagacggcctaatgtattatgaag

SEQ ID NO: 414661 - DNA, 3044 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414662 - DNA, 3142 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagcgtctgttcctcacacaccccgcccaaggacgtgcctggcagcggcctggtgctccccgccgcagccacctcacccttgggtttctgtggccctgcagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414663 - DNA, 3003 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414664 - DNA, 3065 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagtgtgatcctaaaaaaa

SEQ ID NO: 414665 - DNA, 3195 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtaaaaaaaaaaaacacaaaacaaaacaaacaaaaaaacaagaaacaaaaacaacaagggggggcccccccaacaatacccccctgggggcccccacataagccgccccccgcttttggggcacaggggggccccaaagggggccccataacag

SEQ ID NO: 414666 - DNA, 2935 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414667 - DNA, 3177 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctcagccgtctcagcagtagctacatcagcctgatggatagagacttcatgacgtgcagcagctggaacttttgtttataaagcatctcttttcctcacatttattttgaatttcttacgtttcaacctatgcagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414668 - DNA, 3146 bp, Homo sapiens
cgccattctcctgcctcagcctcccgagcagctgggactacaggcgcctgccaacacgcctggctaattttttgtatttttagtagagacagggtttcaccgtgttagccaggatggtctcgatctcctgacccctcgtgatctgcctgtctcagcctcccaaattgctgggattacaggcgtgagccaccgtgctcggcggagcaaactttttgatcccattaaaacagaccaaaacatcgtcaatctcttgtgtgtcaagccttctttccagcaaatgaaggccagaacctctgaccttggtggagtgtgcttggcccttggttggccaaggctctccacccgggctccccttactcttctttctttcctcactgttcgtatctttctcaagtaattcctgtgtgtcaggtgtcaggggcaggcctccaggagcttccagagcacacctccggagctgactgagagccctggccgggtagtgtccaggaagagctcctggcgccatggagagaggagagaggatgtttctggcctggatggctgggtgggccaagaagcacttgggaatttagttatggattagagattcatcttggtaaatcacagcctgttactagttgggaacttcagtcttccccaaaccttccacatttcaaagctggtgctttattgcctcctgcctccctttggcttttatctccctacttgcaccagcagccgtctcagcagtagctacatcagcctgatggatagagacttcatgacgtgcagcagctggaacttttgtttataaagcatctcttttcctcacatttattttgaatttcttacgtttcaacctatgcagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414669 - DNA, 2677 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414670 - DNA, 2035 bp, Homo sapiens
agctcggtacccggtgtttatcgatgccaccctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414671 - DNA, 2784 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414672 - DNA, 1525 bp, Homo sapiens
tgtctaaatgttttcactatagccaagatatgaaatcaacctaagcgtccaccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414673 - DNA, 1416 bp, Homo sapiens
gctgacttcgtgattctaggtggcatgctggctgtagcacagtgagtcaggtagtgagctcatcgagacttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414674 - DNA, 1643 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatca

SEQ ID NO: 414675 - DNA, 1656 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtttatgctgtaatagtttatgctgtaatagtttatgctgtaatagtttatgctgtaatagtttatgctgtaatagtttatgctgtaatagtttatgctgtaatag

SEQ ID NO: 414676 - DNA, 809 bp, Homo sapiens
gcgaattcactagtgattctgctccgcccctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414677 - DNA, 1048 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccacgtgagggaggctctcatgagtgcctggcctgggggttcatgatgaagacagcgtggacgcagccctctgccggtaccggcggaggtgcggggaaacacagccgatagaccactac

SEQ ID NO: 414678 - DNA, 1067 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcctccgagctgcatgtactgtttgggggagctctcacgcatgttgggtacgcccgcaaacatgctcttcccttcagaacgggattctgctaggagcagcaacagcctcctacaccagggccaggttcctcatcgaaaacttcaagctactagactcccgggatcacaga

SEQ ID NO: 414679 - DNA, 412 bp, Homo sapiens
tccacagtagagcagttaattgcctacctcaggtgggtggctgacttgggagctgattgtgggaaacagcccattctttatgacggcaagggctccactttctggtgtttgtgataagtctagtcagcttaccatgtgtggtccttgcctatcattaattcttccagaagttgtcttttgcttgggtaggtggtttggctgcctctggacctaagggccaggtgaggtagcagtgtatcaagacagtgctccccgccggcacccaccctcaggccccctaacccttgtccttctctccagctggctgcgtcctggtgttgagcaggaacttcgtgcagtacgcctgcttcgggctctttggaatcatagctctgcaggtacacgggccgcgtggtcggggctcccttctctt

SEQ ID NO: 414680 - DNA, 415 bp, Homo sapiens
agctcggtacccggtgtttatcgatgccacccccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414681 - DNA, 3306 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtaaaaaaaaaaaaaaaaaaaaaaaatttggggggccgcgtccgaccccggaaaaatgtttttcaaacccatccggtgtggggcgccgggccccatgatggtattgcaccttggcaagccgtggcccaaagaaactctgcgccgcgacgtggtggttttcccaccataaaaagcgcggcgacaccgcgtttcggaccatccgaggcgtccgcgctccggtctccgacagggccagagtcgtatacgccgcgccggagggagacag

SEQ ID NO: 414682 - DNA, 2797 bp, Homo sapiens
ttgcttggtggtactcctgcccagtgccaggttcctcatcaaaaacttcaagtcccataaaatgctgtaggcaatcgtctgcagagctattgattccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414683 - DNA, 2990 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414684 - DNA, 2595 bp, Homo sapiens
aaaacgtctgtaacgtaagtggtagcgagtgcccctggggggtgttttaaaatttcaaggcgacggaggggggggtggttgaagttttagttgatgtgcttggctggcgattgaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414685 - DNA, 2390 bp, Homo sapiens
tgcctttggaaaggctgagactcaagtatctctctcttctttcccctcagacgattgcctacagcattttatgggacttgaagtttttgatgagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414686 - DNA, 2880 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 414687 - DNA, 2580 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccacctcgcccatttggccgcgtgcactgagtgtcactttgctgcagctcgtttctttccaataaaagtttctgtgacttaa

SEQ ID NO: 414688 - DNA, 1861 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagggggactacaggcgcgtgccaccacacctggctaatttttgcatttttagtagagatggggtttcactatgttggccaggctggtcttgaactcctgacctcgtgatccacccgcctcggcctcgccaaagtgctgggattacaggcgtgaagcactgcgcttgg

SEQ ID NO: 414689 - DNA, 1276 bp, Homo sapiens
cagtgtgccctgtttgcccactctcagaccccggagttcatcaatctcggagccgctggccaatatgtactcatgtgggaaccagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatca

SEQ ID NO: 414690 - DNA, 1623 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414691 - DNA, 1656 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaataaaaaaatggtgcaaggagaaaaaacctcgtgcc

SEQ ID NO: 414692 - DNA, 2349 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaataaaaaaaaaaggaaaaaaaaaaaaaaaaaaaaaaaaaaaaaaaaaaaaaaaaaaaaaaaaaaaaaaaaaaaaaaacagacacaaagacaaaaaggacacccagagaacagagaggacgggcgagagaaagcaggacggcacagcacacacaggagcgccaacagggaaacacacaaagaagggcgcaaacagaacacagcgggcaaaaaacaggcgacaggagaccaaggtgaaagagcagcgacaggagaaaaaacagacacgacggacacacagcccagaagaggggagcacaaaacgggggagagcagacagaggagacagacgaccggccgaaacgaaggacgcaggagcagaagaagcggcagatgactgagcggaagacagcgaagaggcagggcaccgatagagcaaggaagccaacaagaggaccgagcgagcgaagaacagacagaacaaaaagcgcgcggaccgccgagcccgagccccgccgggccgacgggaatcaacaccagcacacggaacgacgcagcgcgaaagaggccggacggggagcgcggacgccgaggccgggagagcggcgacaggtaacagggccacagagcagaccggaggccacgaggaagacgaagacacgcggcaccaccgacgaagacaagcaccaggcgaaagagagcggccaaacgcagaagagaagggcaggacggaggagagaacgcgcagaggt

SEQ ID NO: 414693 - DNA, 1593 bp, Homo sapiens
  misc_feature (6)..(6): n is a, c, g, or t
  misc_feature (15)..(15): n is a, c, g, or t
gaaatnggctaggtngaggctggtgttaatcggccgaggccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414694 - DNA, 1377 bp, Homo sapiens
acacaaagaccgaaaggaaaatatgctagtagagcccgcttaattgccgaggagctgcgggcattggccgtgaaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414695 - DNA, 987 bp, Homo sapiens
ctcaaggatttgcattggaagggagctcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414696 - DNA, 1422 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414697 - DNA, 696 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcctctaaggctcatgaggacgggtaagaaaaca

SEQ ID NO: 414698 - DNA, 1722 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctccctacgttcctgtacctcctagaactgtcagctatgtgctgtccagacagctactctcacccagactggcacatacccagtggcaagttgtgaccggacagacacacagatgatctgtagcaacttccagcgtgtcaccacatgaccctaccaactctggaagctacaacacaacgtggatgggaagtgggtaccatacatcacttgaacccaggaaggtccaagccccaaactactgataccatgcgagacataccgccctgctaccggacggcagccacgacaattgacacgccacaaagcagcgggactctacggcgcatgaagacgaaccaacagcggaacagacacaccaaacacacccaagaccatcgaaagcaacacacataggaacagccaaagcatgtagaatagacacaagcaacaagcaagaacccccaccagccaccagagaaagaacccaataaaacacaagcagcacaaaaaccccagcaagccaacaaccaacacaacaaggccacgcgcctgagagacaacaccaccctcacagaccacatcaatacggaacaaaccaaacgacaccagtgaccacaccacatgggctagcgaacaactgcggcaggcgcgaccacaaaccctgcaaaacaacacaggaagaagcaacaccaaacaaacacggaccaacaacggcacacaaaccaaccgacaccacaaacactcacaaagagcaacaaaccacacaagagcgctcagcgcaggagaacatgaagcagcaccacggaccaagacgccaaagcacgcacaggggcactatccacgccagcgcgcgagatcaccctacacgcaccagccaaaacggagggcaacacacggcgaacgcccctaggagacaccaacatcaagataggcgacacagccgacgacgcacagcagacaccaccgcctacacggacacactacagacagagagcagacagtcctcagcagactgcaacagcagccccgacgaacaccagcgacacgacaacacaacacaacaaccacaggacagcggaagaaaagg

SEQ ID NO: 414699 - DNA, 754 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccctgtctggactgagcctccgttggcttctgaactggaattctgcagctaacccttccacgactagaaccttaggcattggggagttttagatggactaattttattaaaggattgttttttttttaaataggagcatttgttttcattttg

SEQ ID NO: 414700 - DNA, 1644 bp, Homo sapiens
  misc_feature (60)..(60): n is a, c, g, or t
acaacacacaacaaaaacaacaactacccaaaaactcggctaggtacgaggctgggtggngtgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414701 - DNA, 1790 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaataaaaaaaataaaatgtcgggacataattatgggatgagaaaaaaggatataaaagagacaatggtgaaagaaaggatagagaccaaaatgtagttaaaagtggtaaataagcgacgaccaaatatgagacgacaaaagataaacggcggacacgcgataagaggcaac

SEQ ID NO: 414702 - DNA, 1386 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcgctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414703 - DNA, 1595 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccacgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414704 - DNA, 1194 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414705 - DNA, 834 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttggcccttcccacactctgcctccgtctgcagaactcgtccatctgcaccaggctctgcttcactccccccaagtcttggaattgttctttcctttgagtcacatttcacgctcatggaagagctgagcgtcagatggggcagcggcggttcctgtcgggagggggacgggg

SEQ ID NO: 414706 - DNA, 775 bp, Homo sapiens
  misc_feature (6)..(6): n is a, c, g, or t
  misc_feature (15)..(15): n is a, c, g, or t
gaaatnggctaggtngaggctggtgttaatcggccgaggctgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctccctggtagggtgggccgtgagttcggacgagggatgctccaggtggcatctcagctccagaggtgaagtcccagtggagcctatggctagtcttagatgccagcggggctatgtca

SEQ ID NO: 414707 - DNA, 451 bp, Homo sapiens
cagtgcagctgctgctgcggtcgctctgagatccccactctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaata

SEQ ID NO: 414708 - DNA, 1748 bp, Homo sapiens
gtcctgatgaagtgtgcagactctcagaaacagcaggaaggacttcatgagaaccctcaggctggagaagggactagggcacaaggagagctctcctaggaccaggaccaagaagctacaggcaggcacagtttagctcctgcagagacccagcttttcacaagttggagccttccagagatagagggactgtggtaggtggtgacccacccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatggggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatc

SEQ ID NO: 414709 - DNA, 893 bp, Homo sapiens
agttactctggtcagtgtgtgtgtgggtgtgtgttgggtattgtgtgatgatggagtgctgctgtgagagtactttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatc

SEQ ID NO: 414710 - DNA, 1856 bp, Homo sapiens
gtcctgatgaagtgtgcagactctcagaaacagcaggaaggacttcatgagaaccctcaggctggagaagggactagggcacaaggagagctctcctaggaccaggaccaagaagctacaggcaggcacagtttagctcctgcagagacccagcttttcacaagttggagccttccagagatagagggactgtggtaggtggtgacccacccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatggggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatctgctttgttgacaagcgtgtgctttctctggccttattcgcgttctgttctcctgcaaatagcgccctctaaaaagaagagtcagacaataaactggttgaaatatct

SEQ ID NO: 414711 - DNA, 208 bp, Homo sapiens
ttggtggctattgtgcacttgaaatgtggctcgtgcgactgaggaactgaatttgacattttatttaatgtcagtcaatttaaattcaagtagcctcatgtggccagtaggcaccctctagggcagtgtagaaagtgcaagggcagctgggggagaagctcctggcagggcagtggtatcacctcagaggagtttgtagggaggcagt

SEQ ID NO: 414712 - DNA, 783 bp, Homo sapiens
gcgggcggcgcgggcacgggcacgggcgcgggcggcgcggcgaggaggcggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaaggcaattggttccaggacccccacaataccgaaatccatggatgctcaagtctctgatataaaatggcatagtatttgcatataacctctgcatttcctcccgtgtactttaaatcatgtctagattatttataatacctaatacaatgtaaatgctatgtaagtagttattataccgtattgtttagggaataatgacaaggaaataaacctctgcttactttttttttctatatttttaatcatcagttggttgaacccatgatatggagggccttgtgtatataaaaatcaatctagctaatagtgccattgttgttggctttgaacagtagatagatagggttcccccaggatctaaatgataaattctggattttttttttaatttttttgtgttcattaaagagtgcttaaaacctttaagctt

SEQ ID NO: 414713 - DNA, 1245 bp, Homo sapiens
gcgggcggcgcgggcacgggcacgggcgcgggcggcgcggcgaggaggcggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaaggcaattggttccaggacccccacaataccgaaatccatggatgctcaagtctctgatataaaatggcatagtatttgcatataacctctgcatttcctcccgtgtactttaaatcatgtctagattatttataatacctaatacaatgtaaatgctatgtaagtagttattataccgtattgtttagggaataatgacaaggaaataaacctctgcttactttttttttctatatttttaatcatcagttggttgaacccatgatatggagggccttgtgtatataaaaatcaatctagctaatagtgccattgttgttggctttgaacagtagatagatagggttcccccaggatctaaatgataaattctggattttttttttaatttttttgtgttcattaaagagtgcttaaaacctttaagcttaaaatctcacccttcagaagaaatctttcggtaagagtttctctttgttctcttggtaagtaaagaaaaactttctaattcaatgaaatgatgacacagacaagggacatgcatttatttgatgattgttttaagccgaaatatccttcttgtggagagattcagggaaaatacaggcaaatcaaattcagttgccatgaattctgctctgcttttgacaccccgtcattaagagatcagctcattagaaacgctctcctgtgctgtgtccctcatttctccgtctttaaggggaagagctacttgaaaggcctgttgttttaatggaaattcttggtgtcatttataagctgacccagccatttagagtgatgataaaaggagctagttgatgataaaaggagctagtggttttacaaattgaagaagccaagcgcttttccgaaactgattattgatcct

SEQ ID NO: 414714 - DNA, 2199 bp, Homo sapiens
gcgggcggcgcgggcacgggcacgggcgcgggcggcgcggcgaggaggcggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcagtaagtactttggcatgtgtcccaggtgacttgagacctggattagccattcaattgtcttttaacacagaaacaggtgttagaaaccattttctcagagaaggaaagattctaagctgcaagattgtcagataggagctgaacagaagactttattcaaagtccttgatgttggactcccattgaagagggtaaactgaactttcctgattctatagaaagcatcaaaggaatataaaagggcacatatctgtctgctctggaatgcagagagggtgccgtccttgtgtcagcaatgccaaaatatatgtgcagtctattgcatgaaacaggcatcatggatgacacggaatcacgtgggctagcatagggcttctcagactgcatcatgcatatgaatcaggggaacttgttaggctgcaggggagttctgcctctgacaagctcccaggtgatgctgatgtagctggtctgagggccacactgtctgtagcgagggtttaggagatgagagagtgaagggctgacccacccatgggccagtgttcctgcatgttgggggaaagccagcctgggagcatgtgaaaggatccttgcagagctttactgaggccctccatattgagctgcaggagctggagccatgggtaggccattgaggagctgttgggagcagattcaagccgtgtcactctgaagaagtgcaggtgtgaacgtcatgacctgctccagcacctgcacaggcagtggaggcctagtggaggccaagagcattgccgggaccaagtcccaccaggggccatcgtgccagtcagagggcatcatctcagctcacttgcagctgccactgcagacaagtagaacaaactgagaattccacaaaccagccagagtcatatatttgagttaatatatcactttttacaaatgatatcacaaattagtggagaaagatacattatgc

SEQ ID NO: 414715 - DNA, 836 bp, Homo sapiens
atgctttcaactactataatcacaaaatttatagataaagtgtttcatgttatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaacatttattataaatggaatcacat

SEQ ID NO: 414716 - DNA, 1981 bp, Homo sapiens
tgatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagcttatgacatccctttcccttctcaagtggacactgctatgctctcacccctcactcagaactaagagtctccagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacga

SEQ ID NO: 414717 - DNA, 1034 bp, Homo sapiens
gccgccctttttttcaaaaatcgaaactctttcttgggcctccttgagtgcaacttcaagtctctccaccttcggattcccttcccttaggcacagcaggagcgggctcacagttaactcctcaggttcgaagtaattctgggccccatcggcagatctgctcctatatttagacaaggccgtgccagtggagacggttctcgtgggcccaggactatgctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaagggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacga

SEQ ID NO: 414718 - DNA, 620 bp, Homo sapiens
aggagagtacaggtcgtgctgcagttagttcattgaaaactcatttgctcttggagcagtcaggcagtgactgccttcggctttttttctgctgactaagatctcctatagagagctacaacaatgcccaaaagaaaggtaagtgaaatggaaagacagacggggaatgagctgctgagttacctatttcctaataggaagaatttatttgtttgtttggttttttttaaagctttttggcttcttccattttgtgatgtaatgaaacggaaaggggtagaagggcaaagagcagtcggtgtaaggtttaggatggtcttgcatgcaactggtagttcacttttggagtgttctgtttaaggagagaatctcttgaaaggtgtctccatgctgaattacaaacagccatagcgctgggctgtcgcttcctaccccaacccccttcctccgcttaccctattggagaacacttctcccaaccatacttcagtttcctcctctgccaccggcttttctcggggaaccgtcccgtctggggaacgaaagccatggctttctcctgtatttgcctttgttcttcccgttttcttttttcttttttttttttccttccctcctcc

SEQ ID NO: 414719 - DNA, 2351 bp, Homo sapiens
tgatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagcttatgacatccctttcccttctcaagtggacactgctatgctctcacccctcactcagaactaagagtctccagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaacatttattataaatggaatcacat

SEQ ID NO: 414720 - DNA, 2059 bp, Homo sapiens
gccgccctttttttcaaaaatcgaaactctttcttgggcctccttgagtgcaacttcaagtctctccaccttcggattcccttcccttaggcacagcaggagcgggctcacagttaactcctcaggttcgaagtaattctgggccccatcggcagatctgctcctatatttagacaaggccgtgccagtggagacggttctcgtgggcccaggactatgctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaacatttattataaatggaatcacat

SEQ ID NO: 414721 - DNA, 2321 bp, Homo sapiens
tgatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagcttatgacatccctttcccttctcaagtggacactgctatgctctcacccctcactcagaactaagagtctccagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtaggagagtacaggtcgtgctgcagttagttcattgaaaactcatttgctcttggagcagtcaggcagtgactgccttcggctttttttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaacatttattataaatggaatcacat

SEQ ID NO: 414722 - DNA, 1158 bp, Homo sapiens
tgatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagcttatgacatccctttcccttctcaagtggacactgctatgctctcacccctcactcagaactaagagtctccagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagagaaacgaagatggacacaaaaaggtgaacgacggaacaacggaacctggacgaacgactggacacagagaccacggagaagatgacacaccacggacgaacgaccagacaagaaaacaggcagatggacaccgagaactgccgcatggcccaacagcaagggcagattcaccaagaaggggaaagactgtacaagtcacagacgcatga

SEQ ID NO: 414723 - DNA, 224 bp, Homo sapiens
ttaaaacgtggatgtggaccagtgagtcatctgtgtcttgtcatctttaggagcctagcacaccagtcagagaaatctatggatttggagattgagatccctccaaatcttcgttcctagagaacatctaacctctggcagagtgaaaaacattttgccaatatcagcctgatggaaagctgaggatcagaaaagtcaggtaatatcacacatttgaagggtgc

SEQ ID NO: 414724 - DNA, 963 bp, Homo sapiens
caaggttatccatctcaagtagcctagcaatatttgcaacatcccaatggccctgtccttttctttacttatggccgtgctggtgctcagctacaaatccatctgttctctgggctgtgatctgcctcagacccacagcctcggtaataggagggccttgatactcctgggacaaatgggaagaatctctcctttctcctgcctgaaggacagacatgatttccgaatcccccaggaggagtttgatggcaaccagttccagaaggctcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggactccatcctggctgtgaggaaatacttccaaagaatcactctttatctaatagagaggaaatacagcccttgtgcctgggaggttgtcagagcagaaatcatgagatccctctcgttttcaacaaacttgcaaaaaagattaaggaggaaggattgaaaactggttcaacatggcaatgatcctgattgactaatacattatctcacactttcatgagttcttccatttcaaagactcacttctataaccacgacgcgttgaatcaaaattttcaaatgttttcagcagtgtaaagaagtgtcgtgtatacctgtgcaggcactagtcctttacagatgaccattctgatgtctctgttcatcttttgtttaaatatttatttaattatttttaaaatttatgtaatatcatgagtcgctttacattgtggttaatgtaacaatatatgttcttcatatttagccaatatattaatttcctttttcattaaatttttactatac

SEQ ID NO: 414725 - DNA, 4913 bp, Homo sapiens
cggacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaggaagctgctgcttatatagcccagaggaatcttcttgctagtgaggaaggaatcacaacacctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgaggaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggatggccagaacctcgtgtcacgtggtataaaaaccaggtgccaataaatgtccatgcaaaccctggaaagtatattattgagagtcgatatggaatgcacactctggagattaatgcatgtgattttgaagatacagctcagtaccgggcctcggcgatgaatgttaaaggagagctttcggcatatgcttcagttgtggtaaaaaggtataagggagagtttgatgagactcgcttccatgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccggtggtacagaaatggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgaggccgtggctgctctggatccggctgagaaagctagactaaagtcgcccctcagcaccctggactggacagtcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcaaacgttgctggctctggcaagtgggagccctgtaacaacaaccccgtgaaaactcaccgattcacttgtcatggattagtgactggtcagagttatatattccgggtcagagcagtcaatgcagctggacttagtgaatattcccaggattcagaagctattgaagtcaaagctgctattgcaccaccatctccaccctgtgatatcacctgtcttgaaagttttcgtgactcaatggttcttggatggaagcaaccagataagactggaggggcagaaattactggctattatgtgaactatcgcgaggtcattgatggggtaccaggaaaatggagagaagccaatgtcaaggctgtcagagaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggagaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaggaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaattccagaggttgaaacaagctgccattgccgagaaaaatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgagttgggatttgctgcagctgtgaagccatggccgtgtctcgtgtgttgttacagaggtgatgtgcttttcgacgggcgcctcgtggcttggaacctcctctgtatgaataaacagttttcacgtc

SEQ ID NO: 414726 - DNA, 412 bp, Homo sapiens
cagccgcctatggtgcaccccgactggcatggctatgctgggtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgagttgggatttgctgcagctgtgaagccatggccgtgtctcgtgtgttgttacagaggtgatgtgcttttcgacgggcgcctcgtggcttggaacctcctctgtatgaataaacagttttcacgtc

SEQ ID NO: 414727 - DNA, 4219 bp, Homo sapiens
cggacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaggaagctgctgcttatatagcccagaggaatcttcttgctagtgaggaaggaatcacaacacctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgaggaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggatggccagaacctcgtgtcacgtggtataaaaaccaggtgccaataaatgtccatgcaaaccctggaaagtatattattgagagtcgatatggaatgcacactctggagattaatgcatgtgattttgaagatacagctcagtaccgggcctcggcgatgaatgttaaaggagagctttcggcatatgcttcagttgtggtaaaaaggtataagggagagtttgatgagactcgcttccatgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccggtggtacagaaatggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgaggccgtggctgctctggatccggctgagaaagctagactaaagtcgcccctcagcaccctggactggacagtcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcaaacgttgctggctctggcaagtgggagccctgtaacaacaaccccgtgaaaactcaccgattcacttgtcatggattagtgactggtcagagttatatattccgggtcagagcagtcaatgcagctggacttagtgaatattcccaggattcagaagctattgaagtcaaagctgctattgcaccaccatctccaccctgtgatatcacctgtcttgaaagttttcgtgactcaatggttcttggatggaagcaaccagataagactggaggggcagaaattactggctattatgtgaactatcgcgaggtcattgatggggtaccaggaaaatggagagaagccaatgtcaaggctgtcagagaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggagaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaggaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaaggtaaacagatattttgcagattcaaatttactctagatgaatgagccttttaaaaggaatgaagggagttgggcatggtggcttatgcctgtaatcccaacaccttgagaggccaaggcaggaggatgacttgaagtcaggagttcaagaccagcc

SEQ ID NO: 414728 - DNA, 255 bp, Homo sapiens
tcttcagtggccaaacatgaagaattaaaagcataattcttgactgaactggtgggtgggttgaactttaggagtacatgggcggtcattcctggcgcacatatcagtgtgacatgagccctggagcatgtcgtccctctcagccctgctcctttctgtctcctggggcccagtgactgaggccttacgctagaactgtgtatcatccaactctccatttataaaggaaacttcctgctgcaacaacaaaaaaaa

SEQ ID NO: 414729 - DNA, 526 bp, Homo sapiens
ggttgctttttgtctcaatctagataatccattcaataagaagtaaattaattatccttaaccaatggtgggctgagaacaaccctcaaaatagatattttttatgttaaatggggagaaatatctatactttatgttatactggataaaaatgtgttttaagtctaaaaaaaaccagacgagctaaactttgcctagtgtgtctacaaccattttttaggagacgcaggaataccagggcataataagatcagattggtgtaattttgtatgtttttgaaatccttcattaattgtagaaccttgatatgattagaaacaaactgtatttcaacaaacaggtttcagtatttgcacactgaaaaagtgttttgtattttaactataaatatttcacgtatctgtatagaccatctagaaatgtagaggtcttacagcattagaacgaaggaagtttacatgtgctctatctatttttctgagcctcttttaataaaggttgcaagaaggcataaaacaagagttt

SEQ ID NO: 414730 - DNA, 196 bp, Homo sapiens
gatccacccaccttggcctcccaaagtgctgagattacaggtgtgagccactgcacccagcctgtagtttctaagttttctatagtgaacacgcaatacttccttttgcaagcaggaaaagagtatttgcacgggcggccagccacctccatgcaatggaggctgataggtgcccagcaccttccccacgccgcca

SEQ ID NO: 414731 - DNA, 405 bp, Homo sapiens
caatttcaggtctcgagtcagagaacagactatttcctcttccccttaattaacctccatccatttgcttgattgtttgtggctccttctataagggatgggtggaggtgccttacagtgaaaagacaggtatacatacacacacactgtatatatatagattggaaattcaaaggcatgacattcctgggaaccaaaaagcctgtccaaagattagctccatagctagctcaagggctttcaaatgccagaaaagagaactagggcagccagaagacttggccccacaattcaagtattaacactgagcaattctgtgttataatttgcagcagttagaggaaatcccaaagtccacgtttttgctatttcagtaaatttttttggatctcactctgtcaccca

SEQ ID NO: 414732 - DNA, 114 bp, Homo sapiens
gtccatatgtgattaacgctgggatagccctggagatgcagaaaacagccttgttgggatgtttgatgcccttggcttcatcacccatctcacaatgaccagaaactcaatgac

SEQ ID NO: 414733 - DNA, 1090 bp, Homo sapiens
ggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagaccacaaacttaaaataagtaaagaagacagtaaaattcttaaaaaggctcggaaagatggatttttgcatgagacgcttctggacaggagagccaaattgaaagccgacagatactgcaagtgactgggatttttgtttctgccttatctttctgtgtttttttctgaataaaatattcagaggaaatgcttttacagaaaaaaagaaaagtgaa

SEQ ID NO: 414734 - DNA, 837 bp, Homo sapiens
ggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagagctggtcaagattagacccttgcctgaaggagaacccggaggggcctttcccaagatagccaaggaaagtgtcgggc

SEQ ID NO: 414735 - DNA, 1116 bp, Homo sapiens
ttacatttaattttatttatttatattttattgtatcatgtttaaattatttttcatctggatatcatcacaaaagtgttattgaaggcaacaattgcaaatatatgtgcagtgctttgcacttatacaaagatacaaagatacttacacaaagattgcatttttcactgtttaaagcaattttcagatgaaatacaaagttttctgggtctctttggttagtcaagtacttggaagctctgaacagtgattatttaggactcttttcgtaccatttaattgcaggctctcctaatctctgtcagcccttcacctttatgaccttgccttatctaccagaacacagatccctcttactaaaggtagcattgtgctacaggccctagcagggaatgttttcaggtctgggacccctctaatcaaaactgtcacaaagatgtcattggcacaaacacgttatttgtcatcactttctgagcagccctggaactagactctggccacagagatcccttaggagacatgagtccttaccattgccaattacctgttctgtgggcgatcctaattgttgaatgcagatcaattaacttatgacatgtgatagtaaacatctatccaaacttaggaggatataagagctagtaaaagaggtgggttccaattaattaaaaacaagttgtgtaatgttaaaagttttaatactttggtaatagtctgtgcaacataaaatagctattaagctttcaatccgatcaaatgaacacttgtctactagggataatttgatcctagtgtattcacttggaggacaaaattaaattagttaatgatcgctttatttcctagcaggatctgatgtgtaaaatgtttctgaaataattttgtctgtagtgtttctgacacaatgctgtggaggaagcatgtgatagcacttactcatatagattatatatatgaagtaaaaacacatagccagaacctttttctgaatatagttgctcagttaattttttcttctgcataagaaatcatctcgaatgttcttatgtgatacgtaaagtggggaaggtggaagataaacatataacccattggattctcttttccaatatc

SEQ ID NO: 414736 - DNA, 308 bp, Homo sapiens
aatgcttttcttttcttgaggcttcagttttcctaatcatcctaccacctcccaaagctagtcactcagaaagaaatttcagagcttccaagaccacaaacttaaaataagtaaagaagacagtaaaattcttaaaaaggctcggaaagatggatttttgcatgagacgcttctggacaggagagccaaattgaaagccgacagatactgcaagtgactgggatttttgtttctgccttatctttctgtgtttttttctgaataaaatattcagaggaaatgcttttacagaaaaaaagaaaagtgaa

SEQ ID NO: 414737 - DNA, 874 bp, Homo sapiens
tgaagccactggccttgagaaccctctcgaggagtctggcctcatgaagatgccagaataaatggcagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagaccacaaacttaaaataagtaaagaagacagtaaaattcttaaaaaggctcggaaagatggatttttgcatgagacgcttctggacaggagagccaaattgaaagccgacagatactgcaagtgactgggatttttgtttctgccttatctttctgtgtttttttctgaataaaatattcagaggaaatgcttttacagaaaaaaagaaaagtgaa

SEQ ID NO: 414738 - DNA, 1590 bp, Homo sapiens
ggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaaggctctcctaatctctgtcagcccttcacctttatgaccttgccttatctaccagaacacagatccctcttactaaaggtagcattgtgctacaggccctagcagggaatgttttcaggtctgggacccctctaatcaaaactgtcacaaagatgtcattggcacaaacacgttatttgtcatcactttctgagcagccctggaactagactctggccacagagatcccttaggagacatgagtccttaccattgccaattacctgttctgtgggcgatcctaattgttgaatgcagatcaattaacttatgacatgtgatagtaaacatctatccaaacttaggaggatataagagctagtaaaagaggtgggttccaattaattaaaaacaagttgtgtaatgttaaaagttttaatactttggtaatagtctgtgcaacataaaatagctattaagctttcaatccgatcaaatgaacacttgtctactagggataatttgatcctagtgtattcacttggaggacaaaattaaattagttaatgatcgctttatttcctagcaggatctgatgtgtaaaatgtttctgaaataattttgtctgtagtgtttctgacacaatgctgtggaggaagcatgtgatagcacttactcatatagattatatatatgaagtaaaaacacatagccagaacctttttctgaatatagttgctcagttaattttttcttctgcataagaaatcatctcgaatgttcttatgtgatacgtaaagtggggaaggtggaagataaacatataacccattggattctcttttccaatatc

SEQ ID NO: 414739 - DNA, 677 bp, Homo sapiens
ggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgtaagtgctgttattgtttataa

SEQ ID NO: 414740 - DNA, 1167 bp, Homo sapiens
ggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaaggctctcctaatctctgtcagcccttcacctttatgaccttgccttatctaccagaacacagatccctcttactaaagattagatcctgtgctgaaagagaaaccaagaaaaaagatgacattccagaagaagacaaaggaaatgtaaaacaatgtgaaatcaattatgtaaagaaatttcagagcttccaagaccacaaacttaaaataagtaaagaagacagtaaaattcttaaaaaggctcggaaagatggatttttgcatgagacgcttctggacaggagagccaaattgaaagccgacagatactgcaagtgactgggatttttgtttctgccttatctttctgtgtttttttctgaataaaatattcagaggaaatgcttttacagaaaaaaagaaaagtgaa

SEQ ID NO: 414741 - DNA, 1146 bp, Homo sapiens
tctactgaaatggctttgatgtcatgcttcaaaatattttgaacactttaaatacatatattcacacaaatatatatacacccacacaatttatctgtatgtgtttatgactttcagattttcatattctcaatgcttctaactaaaatttggttcataaaaagtatcttatataaaacctatagtaaatattttaaaaatgtgcttttccatttttaataacatgtattttggtaaatacttgattcagagagccaatgaattagagttggcatatgagtttcacatagattcttatactaggtaagtatttaccaaaacatgtatcagaagcagaaagttgttaaaaaggtttaccagacaacaagactggaaagtgtattaagtgtgcctggccttgacatcttgttctggataatctagtctacatcttaatttaggaaagctaatctgtaaaactgttcaaatatttgaacaatatttgataatgcttacataatctttcaagataatatcaggaaacagagttctttcatgtatgtaagtagttaataggacataacatcagatgtctagatgaattatagctatggcttaattacacaataatctgccttcttagtagaaattgcttatttccagcatttgctgtaaaaaaaaaaaagacagtcagtttacaaaaatatacaatcctatggatttaatttatttaaattttgttcattctaattttttttggtgcgtgataatagcaagttatcttagttgaaaatagagattcattcattaaagaatattaaatcttttgtgcccaagtgccttaataaataagtagaatcttaacttttctgataagcattccagtaaaagctaatgtacatagatatgccttgagccactgtttctactttcacccttctctccacacatattgccacgtctgctgtgtagttacctgcttacatgtacagccatttcaataaatgtattcttttaacattttatcttttaaatttcaaataggaatttatagttggtaaaaataaaaattttaaagtgatttaatattgtcattttcatgttctcaatattgttatagatccactgagaaaatgtcaaataaaatctaatatttcaaaggtgaaa

SEQ ID NO: 414742 - DNA, 2571 bp, Homo sapiens
gcgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttcta

SEQ ID NO: 414743 - DNA, 266 bp, Homo sapiens
gcactccagcctgagcaatagattaagactctctgttaaaaaaaaaaaaaagagcgtgcgcgcagtgggattacaggcatgagccaccgcgcctgaccacattgccatatctgaaatggctggattctcttaggtgcttttctttttctttctttctttctttttttgagacacgagaatcaccagaacccagaaagtggcagttgcagtgaactgagatcacgccattgcactccagcctgagcaatagattaagactctctgtt

SEQ ID NO: 414744 - DNA, 4643 bp, Homo sapiens
gcgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtaactgcttcttaaagctatcccctcctgtcttccccactcccatttagccctgtccccaccacagcatcacacctattgccctcccccctagaagccccactcatccgctgactctggcctcgttttcctaggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttctaaaaaatatgtatttccctagttaagtcccctgaaaaggtctaaatataatgacaccccagtaacactgagcagcactagtatacagactgtggtctctataagtgccatttctgactaagaactagggacttttgtgaaaacagctgattccaggtctggggcaagaaatgtgcaaaatgtgtccaggatattttgtg

SEQ ID NO: 414745 - DNA, 4633 bp, Homo sapiens
tgtggcatcaaagctggtgagaagagatgatgggacaggtatgggagagatgctgaggccagtgtgggacccaatgggtgcaaggggctcatatgacacctaaggggaggcttccaggaggccttgggacttctaggtgcagggctccgggaagagatcagtactgggacaaagatgtggttgtcaccagcacagacaggaaacaggctggaagtgtgggtaagacaatcctaggaggaaggagggagggagccaataccctaatgcttctgtgtcagacacagaaactgctgagcaaaaaccctctgccaccagttgaggagcctggtacccccaaaagacaggccaggctgagccccgatcagaccatctgaccctgaatctgatcctcccaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttctaaaaaatatgtatttccctagttaagtcccctgaaaaggtctaaatataatgacaccccagtaacactgagcagcactagtatacagactgtggtctctataagtgccatttctgactaagaactagggacttttgtgaaaacagctgattccaggtctggggcaagaaatgtgcaaaatgtgtccaggatattttgtg

SEQ ID NO: 414746 - DNA, 3041 bp, Homo sapiens
gcgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaagagaaaaggagaggggggagggaagaaaagaaagacaggagagaggggacagcaacagagccgacgactgacggaatgttcttggaaaacggaggagccagccagaaaggaaggggaacagcatattcagagagaggaaaaccggcgagagcccgcgaacaaaccacagcaggcgaggagaagacgaggaacacggcaagcgcaagaaggagagctgccacgcgttcgagggagagaagcagacaaaccaaaaagcgagtgggcgaggccgaacaaaaaggagaaggacaaaacaacccacgacagagagaagcaaagaggacggacggacgagcgggagacagcgaacaaacagagcgcgaggggaagcggcgag

SEQ ID NO: 414747 - DNA, 3190 bp, Homo sapiens
cccagagcctccagaacccaaggcctcctctcagtccccacccaacccagacttctccccgcccgtaggttgaagcccctgcccacggtcctcccatccatccaccagctgcaccccgcgtccccaaggggctccagcttcatagcgctgagccacaagctggggctgcctccagggaaggtgagtgcccgtctcctgtgacttgtctccccagccccgccccaggtgaccgtccttccctcctcctccaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttctaaaaaatatgtatttccctagttaagtcccctgaaaaggtctaaatataatgacaccccagtaacactgagcagcactagtatacagactgtggtctctataagtgccatttctgactaagaactagggacttttgtgaaaacagctgattccaggtctggggcaagaaatgtgcaaaatgtgtccaggatattttgtg

SEQ ID NO: 414748 - DNA, 707 bp, Homo sapiens
gcgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtaactgcttcttaaagctatcccctcctgtcttccccactcccatttagccctgtccccaccacagcatcacacctattgccctcccccctagaagccccactcatccgctgactctggcctcgttttcctaggtatggccaccaggacagtccacaggtgagaagcatatgctacaagattctctttcatccgaaaaatgacttgtagatcttctgctctaagcccaaccaggtgctgggtgatgctggggacaatgggtcacaagacagccttgatctccatcctcatagggcttaaagtccagtggaaacagcattagctcagccaggtgcagtggctcacacctgtaatcccagcactttgggaggctcacctgaggcctcatctcaggtgatgagatcacctgagggctccaggaagcgatcagtactgggacaaagatgtggtttgggaggcgg

SEQ ID NO: 414749 - DNA, 431 bp, Homo sapiens
tttagaggataattgacgtgtcttgtaacgttctctgtccgcttacccaaccccacagaacccctcatgatgaccactttggcacttcgtaccagcagtggctgagctcagtggaggtgagagggcagggctctcaggaaagccacaccctcccgctccttgatcaaaacttagggtgccaggacctaactcttgatgacagccctattcccatggggtctcagctcacagccctgccccgatcctgccctgacttcaccctccctccccctagacgctgctgacaaaccaccccccaggccacgtcctggctgccttggagcacctggctgcagagcgggaggcagagattcggtccctgtgcagtggggatgggcttggcgacacagagatatccaggtgtggggcagggtattctcacagttggggaa

SEQ ID NO: 414750 - DNA, 4509 bp, Homo sapiens
gcgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttctaaaaaatatgtatttccctagttaagtcccctgaaaaggtctaaatataatgacaccccagtaacactgagcagcactagtatacagactgtggtctctataagtgccatttctgactaagaactagggacttttgtgaaaacagctgattccaggtctggggcaagaaatgtgcaaaatgtgtccaggatattttgtg

SEQ ID NO: 414751 - DNA, 728 bp, Homo sapiens
ctgggctagagcaggggagggggcacaggtgaggcccatagtaactcctctttctgcctctgcactgtaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctggtaagagtcctggtcatgggagaaggggcagggagcctggagtcaggcagatgctagggtccccctcaggtcccttcctcctcttctccctagcgtgatgtccgaacagcctgcaccctccgggcccagttcctgcagaacctcctgcttccccaggccaagaggggcagcctcccaaaccgtcatgatgaccacttttggcacttcagtacacagcagtggcctgagcttcagtggagacggctgctgacgaaacaacacccg

SEQ ID NO: 414752 - DNA, 4681 bp, Homo sapiens
gcgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtgagaagcatatgctacaagattctctttcatccgaaaaatgacttgtagatcttctgctctaagcccaaccaggtgctgggtgatgctggggacaatgggtcacaagacagccttgatctccatcctcatagggcttaaagtccagtggaaacagcattagctcagccaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttctaaaaaatatgtatttccctagttaagtcccctgaaaaggtctaaatataatgacaccccagtaacactgagcagcactagtatacagactgtggtctctataagtgccatttctgactaagaactagggacttttgtgaaaacagctgattccaggtctggggcaagaaatgtgcaaaatgtgtccaggatattttgtg

SEQ ID NO: 414753 - DNA, 4351 bp, Homo sapiens
tgcctagaatgataccacctgtatacctagaacaccagccctggggaaacagccacaaacagagaacatgtccctgccctcctggagcttatgctgtgacacagagaagacagatagtaaagtaggaaccaaacagaccctatcatttctggtagagatgagtgctgtgaagaaaagcctatcatagaagggagagggagatgctgccctagcgagggtggtcagcgaaggcctctgaggaggggacattgagttggaagaggaatttctgtggagaaggaatagcaagagcagaggtggtgtgctcagcatgcaggaagagcagcccggaggccaatgtcagctcaagtttctcaggcaagaccgagaacctgaggaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttctaaaaaatatgtatttccctagttaagtcccctgaaaaggtctaaatataatgacaccccagtaacactgagcagcactagtatacagactgtggtctctataagtgccatttctgactaagaactagggacttttgtgaaaacagctgattccaggtctggggcaagaaatgtgcaaaatgtgtccaggatattttgtg

SEQ ID NO: 414754 - DNA, 1519 bp, Homo sapiens
gcgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagtgagactggggctgccccacccctgccctgcatcccctgccatgggtgactgtcactccc

SEQ ID NO: 414755 - DNA, 6658 bp, Homo sapiens
ttagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtatggtcggacttaggtccccaggtt

SEQ ID NO: 414756 - DNA, 5969 bp, Homo sapiens
ttagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctgccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtatggtcggacttaggtccccaggtt

SEQ ID NO: 414757 - DNA, 6604 bp, Homo sapiens
ttagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtatggtcggacttaggtccccaggtt

SEQ ID NO: 414758 - DNA, 1280 bp, Homo sapiens
gctgttcatgtgcttagggagcctttgcactcctcgtgtgttggcaccgagttgaaagacgcaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtatggtcggacttaggtccccaggtt

SEQ ID NO: 414759 - DNA, 355 bp, Homo sapiens
catatggaaacggaggaagaagatgacacaaatgatgaagactttaatgtggaaataaggcagttttcttcatgttcacacaggttttcaaaagtaagtgaaatgtggcataaacatacagagtctctctgggaggatctcccgctggccagatagtatccccgaacagctggacacttaccgttttccagggtttgaggtctcctatgcttaaacttccttttgttgaagaaaagtgacctcctcaacttatagtctgtccctatcccctaggcctttagactgccattttaccttctctctttcctgtgagacaacagagattcagatagctgagaccttgggcttacctgag

SEQ ID NO: 414760 - DNA, 317 bp, Homo sapiens
aatagatgcctcttccatctcttcctcctccacgtcacctttctcaaagcaatcacatgttgttaatgttcgcctgacaccgtctggacttactggccacataggagtatgttctctggcgtttactcttcctgctgtctctctcttcccgtcttcccacctctcctatcctggattttcctgaatgtgtttatcccttcttctttgtacagttggcagtttttcagagcacttggatcagataaatggacgaagcgagtgtgtggacagtacagataattcctcaaagccatccagtgaacccgcttctcacatgg

SEQ ID NO: 414761 - DNA, 5768 bp, Homo sapiens
ttagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctgccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtatggtcggacttaggtccccaggtt

SEQ ID NO: 414762 - DNA, 2143 bp, Homo sapiens
  misc_feature (22)..(22): n is a, c, g, or t
agctcggtttcccttttggggnctttgctggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctgccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtatggtcggacttaggtccccaggtt

SEQ ID NO: 414763 - DNA, 5905 bp, Homo sapiens
ttagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagatcgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtatggtcggacttaggtccccaggtt

SEQ ID NO: 414764 - DNA, 2462 bp, Homo sapiens
  misc_feature (1)..(1): n is a, c, g, or t
  misc_feature (3)..(3): n is a, c, g, or t
ngnaacgtagctttttatagtttttgatccatgtcataaatttggctatgacaaaggggatattccgtctttaactctctggcaagaacattagctattttccagccctaaaaagtttggtccttagtgttctttgtaatgcaccaaagggccagatttctatcttcagaaggacaggctgtgtttgggtatatgtacatacattcacctgtatttgtgagtgtgtagtcaatgtgtgtgggttgattgtgagtagttttctttgaacttttagagaaagaaaaatattacaaatcccaagtcccagattgtagcatcattgtcagaattccaaaaattgcaaagctgaatgaatgaggaagataacagccttacaaaacacaatgacttggttactaaatgcccctttccactggatgttgttagaaaaagtatattttatcctattttgtttcgcttagcgtaattataaattttcaaattttaagggtgagaaggaatgaccaacagggaaagtaatcctctcattagctcagagcaatgaattttggctttgaaacttacattttaaaagagggttatccttgttcagaattttcatgtaaagtcctttttttgtaaaatacctacatatacgtgtgggtgtatacagcccctcccccacatacacacacacatacatatatatgtgacaagtattaacatcagtgccagacttgaacattttatccctaatgccttctctcaactctgccagtgagtgagtgtttgttttgttttttcttcaacagtattgaaaggaaaaggaattttttgaattagataactataaggaaatttactaaaggaataatgttttattgctataatggaagtacataattataaccataatgttttaagtttattcctgattttttggcattcttcgacaacaaaaacttttaaacttaaaataagctaatagatttatgtttcttcaatttaaatttcagtgtgtatccaatgttttagagcagtgattgaaaagaaagaactgtaattacaggaaaaataattcaccaccagaacaccttaatttttttttttttttttttttttgcgacagagtcttgctctgtcgccaagccagagtgcagtggtgtgatctcagttcactgcaagctccgcctcctcgtttcaagtgatcctcctgcctcagcttcctgagtaggtgggattacaagcatgcaccaccatgcccagctaatttttatatttttagtaactagtagttctttaactttcatgaacacaatcatcacttagtggtggtgagtgacttgttaaatatccaagtttcttgatgcagagactcagtaggtctggaatgcggcccaggaatgtaaatttaaaatataactttctccttttcccactgatgccattggtccttttctcaattttgagaaaacactgctttagatcttatgaaaaaatgtcttggacaaagggagttagacttattcatgccccagttcgtttccttgttagggagtatcttcacacactcatagaaaatgtgtgctcctttcaaagaccatggagccctcttcaatgcaagtattcctgtgttgacttgacaagcaactggagaaaatgttataaaaaattttaaatatcagagggatgattaaattaagttagcttcaaggtcacttccaactttgacctttattccatgaatcctgtatatgttcagtattaattctttttttttaaagtaaatatcagaaaagggaaaggggatgataaagcagtgagttgtctgttttgtgtctttgattttcttaaacaacatatggttgaggactaacattagacacctgtgtgtagtggcctctgattgcttggggttgaaataagctgtctcttcaatcattgcatgcattttttagtatataggtactctagcaaaatatgtattcttttagaatgcacacatttttagtttacatacatagcatggtattatatatcacattctgttctgtactttccattgaccattatgactttaaaatcaatttacattgcaatgcataattgaatctgcagcatctacctgctccacaatctccataaagcgcatcctttacattgtacctatttgttctccaagagatgaaggggtttccaggttccctccaattcctcaccagcaaaaaagatgctaagatgaacatcctcttacatatctcctgatggacctgcacacatcaatttccaggcatataaaaacaaactttaacaaagagaaatctattggggtttcaaattttctgtgtctcttagaaacactgaaaagtcgatttatgataaccttatggaaaatgtagcttactccttgaaataattggtattaatagaattcacccattctcccctgtagcactttctagagtcagaacctgatttaaaca

SEQ ID NO: 414765 - DNA, 461 bp, Homo sapiens
aaagtaacacgactttcaaatatgtgggttctgacatcaattcagtacctaatttccactctctccactttgactgccagtgcccatagtaagggaaaccagctcttggaataggaaataatgggggcagtttttcttcccacaagatcttaggttacattgatcatcacttgagattgcatgaatgttcttgctgtaatggcaaaaacatagacttaggaaagagaaaggagggggtgtctaccatcaggaatagtaatagccctccaaaggcagtgtggtctcccagctatgcagagaccaagaataaccagcaggcaggaatatggcagtggtgacaggctggatagagctttctccaaccaaaagatggggctccttcatgggcaatgtgcttttccctcttctggcacctcaacaactgaagagagtgggtgccactaaatgcactggcaataagg

SEQ ID NO: 414766 - DNA, 898 bp, Homo sapiens
  misc_feature (23)..(23): n is a, c, g, or t
  misc_feature (33)..(33): n is a, c, g, or t
  misc_feature (36)..(36): n is a, c, g, or t
gtgaagaaagtgggtctcatatncatgactggngangcataaagataatctctgttacctgattgcttgagccaggaagtcaaggcttcagtgagccgacatcactccattgcactccagcctgggcagcagagtgagactctgtctcaaataaataaataaacaaataaaagaaaagacaaatattaaattgtttagtggacacaggagacaacattgttctatttgattatctactgcccagtcagcttccttgggcactcaaccaacaggtaacagagattatctttatgcttcaccagtcatatatatgagacccactttcttcacacccctgccaatatattggatattgtcagactgtagatatttttgccaatcttaaagatgaaaatggtagagaattacttttttctgtgaatttttctgactactgttggattcgagtggttttcatatgctattagccatatgggttttcttttatggagagagaattccaggaatgcaagattggttaaaggaaaaaagtctatcagtgaatgttgccctgttaataatgaattaagcaaaaaaaaaaaaaaaaaaaatcttctcattagatgtagaaaaacatgcaataaaattcagtatacttccagcatagaaactcttattaaactaaaaaatagaagagggaagtaagtattgttgaccaaaacccattcaccctatctgaaactttatatttaatggtaaaattaaaatacattctctttaatgtcaggaattgtctttggatgtcctagtcaatatttcaagacatgagcattcaataagatgtattagaaattaaaaggaaaataaaataattgaaataataaagagttcacttatattgctcagtacaaggtcagta

SEQ ID NO: 414767 - DNA, 2619 bp, Homo sapiens
gacagtcattcagatgtttggcattgttgtagcagggctactgccagtgtgggggaaaatgctataaatccacttctttgattgccatggatttgaaagaaccatttgcccaacagcatgattcgcctctgaaagtctaaaaataattttcaatttttccatgaaggtgtgtggagggtagacacacagcctacgcataggtctgcatgacatgttttttctttttctttctttttttttttttttttttttttagacggagctttgctctttgttgcccaggctggagtgcagtggtgcaatcttagctcactgcaacctctgcctcccggtttttcaagcgattcttctgtctcagcctcccaagtagctggaattacaggagcccgccaccttgcccagctaatttttgtatttttagtagagacggggtttcaccatgttggccaggctggtcttgaactcctgacctcgtgatccacctgcctcggcttcccaaagtgctgggattacaggaatgagccactgtgccagctgacacgttttttcttttgtgtgaattttatgttctagttttgggacaagggtaatcagttcttgactagtgaacaaatgagagaacatttaccccttactcattttacacatgcaggtcagcagaagccctagagttggttggcacagtcgcagttgactgagcatagaggaaacaggtctttttacattctctctcatcactggagctcagttgaactctaagaccttagcactcaaagagtctgaaaagaaatgagggagaggctaaatttaagctctccactcccacagaaaggacagggcaccctacaatctaaaagccagtgaggcagcctatcatctgtttcacatctgttctgaaagggatagtttaatgcaagaagtaagaggcctgtagtgactgtaaactcatgaaatgtgcacattggttatctgtgcacatttccacttgcaccataacataagaaagcgtacatggagtgtaattacttccagaagccccgtctaaccaacctattcagatgtggcacactttctgtcataaatgagagaccacacgtagagctcggtcaccaaggaatgcccaacatccctttacctctcacaatgagcagccacgctcaccgggaagcagtgtggggacttcagtggggtgtcccttagtggagaacacctttcatcatttttatagagacaattcccttgagaatgtaggcttttcatcttaggaacaattaggaagaatctccagctgggagtgttcttatgtatacagaaacaatgggtcgcattggttcatacttaggtgatattaggtttggctatattgatgtttggtgccacttaccttctagattttcccaaaagttgggtcattgctatgggaaattggggcctgcagatgggggagaaatgatcattattggtgcagggaaggggttcaggcagagctggagtctgaggctcagtgtgagaaagcactggcagttttctagtagagtcaggtcctgggctcctctcctcacccactgtgtcccgaactgaggccagctgtgatcggcaaattgcttatctctaggtagtttaaagaaaacgtaagagtttggggggtggtgggagaataactgtagaaagaccctaaactcttctctcccccagcaaattatcttgtataatgtttaaaaacccaaaggccagatctccccttttaacgtgaatcagaaggaggatggcaattggaccaagggcagagtggccacacttgaaacacattataaaatgggaatatatttcagggaaccccacccccacacttccactccacctcacacctgttggtcctgctttgtgggtgattgattgatacccaaggactgccccacctttaaattcctgcaatttatgctgcaaccaacatcttagtgtttgctctctccgggaagaggccaggtgggggagaacatacggtccagagcctgagatcgcctggctggggtgcaggcaagcaggaacccagtctagatagaatgcagtgttctctaaagctatggatggtttcagtgaaatgtctgtgtctgacaatcgtcacgcaagagtacttactgtcttcccttgtacatacattgtctgtgtttagcttttcctagtattgtgaggtttcaaataggggttccatgtaaatactctttctgctactgaaatgccggcccccttgagtatgcatcacccccacagatggttttgcctttctctatgctaacactttttgagccactgacgtgcagatcggtggttagtttcttgggcttttattttgcaattttatatatatacacatattattatatatatatatatatttatgggttggttttgtatagttttctgtttgaatctctgagcaccaaagctgccctttgattttcacgagaactttccaaagccacttcctgagccctcctgctgctttggtgtctgacggtgatgctgcggtggcatctctgcccgtgaatttctgtatgtgtgtgctgttacctcacctgcagacatgaccctagtaaatctaacgtgcttggcttccca

SEQ ID NO: 414768 - DNA, 436 bp, Homo sapiens
actggtatatggatgtgtgggaaatacttccgtaataatgaactgtgctgagttcgtggagcattaaaaagtgcttcggttcaagctattctattccaccttttcaaaaggtgggttcttccctgaaccattgcatagtgagaagtttagtatctacaaaaggtgtggtgtttcgtggttttgcatcttgtttgatcttcacactggacagtagcaactataaattttaaaaagttttctttctaaaattactctggaagcttacatgcagatgaccattgctctgctccaccacctttgctggccccctacagcctctgcaatgctctctccattcattagccattcattaggctcctcccaccctgacttcacccatttaattgttcccctctctaaaggtccatttaaaatgtgatcttctctctcatactgc

SEQ ID NO: 414769 - DNA, 1716 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414770 - DNA, 813 bp, Homo sapiens
  misc_feature (562)..(562): n is a, c, g, or t
  misc_feature (566)..(566): n is a, c, g, or t
  misc_feature (588)..(588): n is a, c, g, or t
  misc_feature (607)..(607): n is a, c, g, or t
  misc_feature (609)..(609): n is a, c, g, or t
  misc_feature (616)..(616): n is a, c, g, or t
  misc_feature (638)..(638): n is a, c, g, or t
  misc_feature (648)..(648): n is a, c, g, or t
  misc_feature (670)..(670): n is a, c, g, or t
  misc_feature (673)..(673): n is a, c, g, or t
  misc_feature (676)..(676): n is a, c, g, or t
  misc_feature (687)..(688): n is a, c, g, or t
  misc_feature (701)..(701): n is a, c, g, or t
  misc_feature (704)..(704): n is a, c, g, or t
  misc_feature (710)..(710): n is a, c, g, or t
  misc_feature (713)..(713): n is a, c, g, or t
  misc_feature (717)..(717): n is a, c, g, or t
  misc_feature (728)..(728): n is a, c, g, or t
  misc_feature (737)..(737): n is a, c, g, or t
  misc_feature (741)..(742): n is a, c, g, or t
  misc_feature (747)..(748): n is a, c, g, or t
  misc_feature (766)..(766): n is a, c, g, or t
  misc_feature (777)..(777): n is a, c, g, or t
  misc_feature (786)..(786): n is a, c, g, or t
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggtncatntttttcacataccattttaatntttttcttactcttcattntntattccntcatctcattcttattttaacnttaatattcnccttaacaaccatttttttcanttntcnttcctttattnnaatcattttaatnttnttcatnttnattnttccatatacnattttatcnaatnnatttnntttcttaccatcctttancatatttaccntttcaatantttttcttatttcctcaatttttttta

SEQ ID NO: 414771 - DNA, 1737 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttggaccctctcactgcccacagcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414772 - DNA, 2587 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtgggggtgagcctgggctaggcggaaaccggggaaatgggtaccttggggggtaggaggcatggccatagccctgtcctgcagaccagctggttgtgcgatgggacaggaggggcagcccgccgggagggagggctgggtggtgggggggtgaccacaggcaccgctctgacgccacatgttacagcacagaccaggtgaagggtgtgctgactctgcagggggatgccctcagccaggcggtgagtcccccggccctgtcccctcccatcctgccaatggggaagagcatgggagctcccactttctctctgtacaagccctgcgactctgggcgggacccttgatctctctggcctcagttttctcctttggaaaatgacagcaaccctcacaccttctcccgggatcggtgtgcagattcagtaagaggtgcaggagaggggttctttgcacacggcctggcctggcgtccggaccagtgaaacatgggcattggtggattaggctggccacacatcacagttgaatcagccaatgcctgaactccagtctgcacccgactctgtgccaggcaccaaggcgtggggggaggcccccctcctgggctccatctgttgccctttgtagacactagatgcaccccgttcgcacagagcctcacagaggctgcctttcctcttccccttcccctttcttcacctctttccatttcacttctttgtggctcttcttgggcctggtttcctgtttcctgacctccctgttcaacccccaaacggccaaggcattgggagaccctctgccctatacagcggccaaggcctgaaccaccacacaccccatttctgccctgggcttaagggctcagagtggctgtggcaggaggtgcccccccactgcccagctcaccccactcttgcctgtcaggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414773 - DNA, 3128 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggtaaggcgcgcgggccagcgggcgggccggcggggcggcggggccgggcgcgaccgccgggtctgtcccgcaggaggaggagttccgctggctgctgcacgacgaggtgcacgctgtgttgaagcagctgcaggacatcctcaaggtaacgacccgcgccctgccccgccgggcgtggcggccctccctcctcatttccctggctccacctggggccgcgcggctgcgtcctgagcgcctacagtgtgcggctgccgcggctttcaggcagggccccgcctccgcgaactcgagccgacctcattatataagtacctgtgtgcgggcaggggcgggtcccgacgagggtgctagcaagggcctgagtcccgcccggcctcgggtcggggaaggccgccttgggagcagcggcatccaatctgggagccgaagaattctgcctctgcctggcagtgtgacttcagccaagtcactgaacctccctgggcctcccttttctcattggcaaaagggagataacagtacccgcttcgcgaggctggggtgtagataaatgagccaggcagctcacagaagtaaccggcgtagtgcttgctgtggcccaggaccgcgggaggcctctctgcgcttcactctgccgggctccggcactgaggggcccgccaagcaagagaacttcatcctaggcagctgtgggggtgagcctgggctaggcggaaaccggggaaatgggtaccttggggggtaggaggcatggccatagccctgtcctgcagaccagctggttgtgcgatgggacaggaggggcagcccgccgggagggagggctgggtggtgggggggtgaccacaggcaccgctctgacgccacatgttacagcacagaccaggtgaagggtgtgctgactctgcagggggatgccctcagccaggcggtgagtcccccggccctgtcccctcccatcctgccaatggggaagagcatgggagctcccactttctctctgtacaagccctgcgactctgggcgggacccttgatctctctggcctcagttttctcctttggaaaatgacagcaaccctcacaccttctcccgggatcggtgtgcagattcagtaagaggtgcaggagaggggttctttgcacacggcctggcctggcgtccggaccagtgaaacatgggcattggtggattaggctggccacacatcacagttgaatcagccaatgcctgaactccagtctgcacccgactctgtgccaggcaccaaggcgtggggggaggcccccctcctgggctccatctgttgccctttgtagacactagatgcaccccgttcgcacagagcctcacagaggctgcctttcctcttccccttcccctttcttcacctctttccatttcacttctttgtggctcttcttgggcctggtttcctgtttcctgacctccctgttcaacccccaaacggccaaggcattgggagaccctctgccctatacagcggccaaggcctgaaccaccacacaccccatttctgccctgggcttaagggctcagagtggctgtggcaggaggtgcccccccactgcccagctcaccccactcttgcctgtcaggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414774 - DNA, 2202 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggtaaggcgcgcgggccagcgggcgggccggcggggcggcggggccgggcgcgaccgccgggtctgtcccgcaggaggaggagttccgctggctgctgcacgacgaggtgcacgctgtgttgaagcagctgcaggacatcctcaaggtaacgacccgcgccctgccccgccgggcgtggcggccctccctcctcatttccctggctccacctggggccgcgcggctgcgtcctgagcgcctacagtgtgcggctgccgcggctttcaggcagggccccgcctccgcgaactcgagccgacctcattatataagtacctgtgtgcgggcaggggcgggtcccgacgagggtgctagcaagggcctgagtcccgcccggcctcgggtcggggaaggccgccttgggagcagcggcatccaatctgggagccgaagaattctgcctctgcctggcagtgtgacttcagccaagtcactgaacctccctgggcctcccttttctcattggcaaaagggagataacagtacccgcttcgcgaggctggggtgtagataaatgagccaggcagctcacagaagtaaccggcgtagtgcttgctgtggcccaggaccgcgggaggcctctctgcgcttcactctgccgggctccggcactgaggggcccgccaagcaagagaacttcatcctaggcagctgtgggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414775 - DNA, 1436 bp, Homo sapiens
gcagccttccccgcgagcggacgcgggagggccgtctgtctcgcttgttcttatttatgccccccatttcccctgtgtctctgtgtgtctgtgttgtttgctgtgtccgttgttctcgcccgtcctgcctccgcttgaacgcaggttgcccgtctcggtggtgggcgtctaccctgggggcaggtcgctcgagggcggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414776 - DNA, 1516 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttattctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414777 - DNA, 1662 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414778 - DNA, 1661 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtgggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414779 - DNA, 1644 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414780 - DNA, 1313 bp, Homo sapiens
ggggcttctggaaggagcactgggccgggcctgagtgggcgctaccagctcccctccttccctctgttccacaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414781 - DNA, 1666 bp, Homo sapiens
gagctccgcccccaagcgggcgccccaggctggtgccggccgcgtccctggccagccggagcaagcctgactcgtgcagccgccggccgcgtcctggccaggcggagcgagcctcactcccgcagccgccagtctggttccaggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 414782 - DNA, 5846 bp, Homo sapiens
cggggtgggaacctcggaaacctgcggaggccgggaggcggctgcaaggggcggggaaggcgggagcccgcagcggaggaggggccgcgggcgggaggcgctgcgaggcgctgctggccctcgggctgcgggagccgggctaggacgccgagcggtgactccccgccgctcccgggggccgtgacggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatgaaatcaaatgactggttgaggtttttttgaacatttacaaataatggattcctgagagctcaggaagtactgtaatgtcagtgacatatgaagctcctgataaagatccacctcattcatatatttgagcttcagaaatacatgtacctagtataatgcttaacagcacataatatttgttgatgagaaatacactgatgaaacaacac

SEQ ID NO: 414783 - DNA, 5687 bp, Homo sapiens
cggggtgggaacctcggaaacctgcggaggccgggaggcggctgcaaggggcggggaaggcgggagcccgcagcggaggaggggccgcgggcgggaggcgctgcgaggcgctgctggccctcgggctgcgggagccgggctaggacgccgagcggtgactccccgccgctcccgggggccgtgacgatgaggaaagtgaggcccaaagaagatttatgttcaggaccatttagtctgagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatg

SEQ ID NO: 414784 - DNA, 466 bp, Homo sapiens
ctatgttttaaattttaatagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagattggctttctcctgctaagtgttttacacaagaaatctcttttgggtatccatcattcatccacggtcagtaggtgtggtgtcagaagacagtgcaaccaagactatatttgctgtttaaaaaggaagtataataaaaaattaagttctcttctccccagtccatcattgttatatatacgctctacagcttgctttttttacttagcaatgtgtcatctacatattcccccttcaaaaattgtagcagtaatgtctgaataaggttaaa

SEQ ID NO: 414785 - DNA, 5056 bp, Homo sapiens
ggcgggcgggggtgggcgccggcaaggggcgggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttcccta

SEQ ID NO: 414786 - DNA, 5106 bp, Homo sapiens
ggcgggcgggggtgggcgccggcaaggggcgggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggagatgaggaaagtgaggcccaaagaagatttatgttcaggaccatttagtctgagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttcccta

SEQ ID NO: 414787 - DNA, 4924 bp, Homo sapiens
ggcgggcgggggtgggcgccggcaaggggcgggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttcccta

SEQ ID NO: 414788 - DNA, 5858 bp, Homo sapiens
aggcgtcagaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaaggaaagatttctatcttttgattttttttttactaagttgcccagtaaccaaccttttaaaataattcacatttatttttaatttttgacaaaaattatatatatttgtcatgttcaacataatgtttcataatacacattgtgaaatggctcagtgtgcatacctcccatacttatatcattttttgtggtgagaatttacttgctcagcaatttcaggaatatagtacgtagttattagctgaggtcaccgtgttgtacaatagatctattaaacttattcttcctatctaactgaaagtttgtatcctctgaccagtatctcctcaactgtaaccaactttaagaaaacattttctcctaccaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggtaaagtccagtttaaattgataaatgtaatcagacttccttctatcctgcattttcatactgacagtttctttctcaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttcccta

SEQ ID NO: 414789 - DNA, 5283 bp, Homo sapiens
aggcgtcagaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaaggaaagatttctatcttttgattttttttttactaagttgcccagtaaccaaccttttaaaataattcacatttatttttaatttttgacaaaaattatatatatttgtcatgttcaacataatgtttcataatacacattgtgaaatggctcagtgtgcatacctcccatacttatatcattttttgtggtgagaatttacttgctcagcaatttcaggaatatagtacgtagttattagctgaggtcaccgtgttgtacaatagatctattaaacttattcttcctatctaactgaaagtttgtatcctctgaccagtatctcctcaactgtaaccaactttaagaaaacattttctcctaccaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccatta

SEQ ID NO: 414790 - DNA, 3355 bp, Homo sapiens
aggcgtcagaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaaggaaagatttctatcttttgattttttttttactaagttgcccagtaaccaaccttttaaaataattcacatttatttttaatttttgacaaaaattatatatatttgtcatgttcaacataatgtttcataatacacattgtgaaatggctcagtgtgcatacctcccatacttatatcattttttgtggtgagaatttacttgctcagcaatttcaggaatatagtacgtagttattagctgaggtcaccgtgttgtacaatagatctattaaacttattcttcctatctaactgaaagtttgtatcctctgaccagtatctcctcaactgtaaccaactttaagaaaacattttctcctaccaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgatcatggaacgtcaagtgggtccactatcgtggctggacgttagccttactgcactgttccgaaatttaccaggcgtcccatataggtccgggggaaacccccctaaggcgtacaagagaaccgcgtcagcaccaaaccacaatcagagccacactcacccactcactacgccatctcgtcgcagaaagagcgcaccccgccgcggtatacactgt

SEQ ID NO: 414791 - DNA, 2239 bp, Homo sapiens
aggcgtcagaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaaggaaagatttctatcttttgattttttttttactaagttgcccagtaaccaaccttttaaaataattcacatttatttttaatttttgacaaaaattatatatatttgtcatgttcaacataatgtttcataatacacattgtgaaatggctcagtgtgcatacctcccatacttatatcattttttgtggtgagaatttacttgctcagcaatttcaggaatatagtacgtagttattagctgaggtcaccgtgttgtacaatagatctattaaacttattcttcctatctaactgaaagtttgtatcctctgaccagtatctcctcaactgtaaccaactttaagaaaacattttctcctaccaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggtaaagtccagtttaaattgataaatgtaatcagacttccttctatcctgcattttcatactgacagtttctttctcaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaaggtaaccactgcttctatgcatgtaaagtgagttgtgacatttggtaaggtgttgatttttagtcacttagaaagccgcattataggctcagagctaaagtacta

SEQ ID NO: 414792 - DNA, 1334 bp, Homo sapiens
ctttccaaactcttcctcatttcccaggtctttgatctgaaaaaacaatctggttagaaaagttgccctccactcataattcactgtgaaatggaaactgcataaacagagacacacagaccctggaaacaccacttgaatgaatgaagtgaatggatgatgtatgtgtgtgtgcatgtgtgtatgttataggtcacatacacatacaaagtgtgcgtctgtgtgtgtataagaggtctaaacttacaaactgagcgtgtcagagtgtgtgatatgacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatgaaatcaaatgactggttgaggtttttttgaacatttacaaataatggattcctgagagctcaggaagtactgtaatgtcagtgacatatgaagctcctgataaagatccacctcattcatatatttgagcttcagaaatacatgtacctagtataatgcttaacagcacataatatttgttgatgagaaatacactgatgaaacaacac

SEQ ID NO: 414793 - DNA, 327 bp, Homo sapiens
ggagtctcattttttttctcaagacatttaaatactgggccatatatgcataagacacagcacagaaatgattttgatgtggcttcctctggtaatcaaactgaagactacttgcctgagcatctaaagccattgtaaggtactagcctttcctcttcatctctctccgcttgtaggttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaag

SEQ ID NO: 414794 - DNA, 5779 bp, Homo sapiens
aggcgtcagaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaaggaaagatttctatcttttgattttttttttactaagttgcccagtaaccaaccttttaaaataattcacatttatttttaatttttgacaaaaattatatatatttgtcatgttcaacataatgtttcataatacacattgtgaaatggctcagtgtgcatacctcccatacttatatcattttttgtggtgagaatttacttgctcagcaatttcaggaatatagtacgtagttattagctgaggtcaccgtgttgtacaatagatctattaaacttattcttcctatctaactgaaagtttgtatcctctgaccagtatctcctcaactgtaaccaactttaagaaaacattttctcctaccaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttcccta

SEQ ID NO: 414795 - DNA, 5027 bp, Homo sapiens
aggcgtcagaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttcccta

SEQ ID NO: 414796 - DNA, 4944 bp, Homo sapiens
cggggtgggaacctcggaaacctgcggaggccgggaggcggctgcaaggggcggggaaggcgggagcccgcagcggaggaggggccgcgggcgggaggcgctgcgaggcgctgctggccctcgggctgcgggagccgggctaggacgccgagcggtgactccccgccgctcccgggggccgtgacgaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttcccta

SEQ ID NO: 414797 - DNA, 5724 bp, Homo sapiens
aggcgtcagaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaaggaaagatttctatcttttgattttttttttactaagttgcccagtaaccaaccttttaaaataattcacatttatttttaatttttgacaaaaattatatatatttgtcatgttcaacataatgtttcataatacacattgtgaaatggctcagtgtgcatacctcccatacttatatcattttttgtggtgagaatttacttgctcagcaatttcaggaatatagtacgtagttattagctgaggtcaccgtgttgtacaatagatctattaaacttattcttcctatctaactgaaagtttgtatcctctgaccagtatctcctcaactgtaaccaactttaagaaaacattttctcctaccaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaattggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagatgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttcccta

SEQ ID NO: 414798 - DNA, 4992 bp, Homo sapiens
attggatcaaacatgtcacaagagtcggacaagtaagtggatcacacgcgccggctgctgctactactaccactttgggctgatggcaactgtaataaaagactagtggccttagtgcccatgcccagtgaccctccattcaatacccgaagagcctacaccagtgaggatgaagcctggaagtcatacttggagaatcccctgacagcagccaccaaggccatgatgatcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcagaagcagaacaggaagaacgggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctaccacggagccgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctttctcacccctccatatctatatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcctgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgctgccatgtgagagctgtgaacagctcagctctgagtcggcaggctggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgtgcatgtttcctaagtccttgagcaatcatggtggtgacaattgccacaagggatatgaggccagtgccaccagagggtggtgccaagtgccacatcccttccgatccattcccctctgcatcctcggagcaccccagtttgcctttgatgtgtccgctgtgtatgttagctgaactttgatgagcaaaatttcctgagcgaaacactccaaagagataggaaaacttgccgcctcttcttttttgtcccttaatcaaactcaaataagcttaaaaaaaatccatggaagatcatggacatgtgaaatgagcatttttttcttttctttttttttttttttttttaacaaagtctgaactgaacagaacaagactttttcctcatacatctccaaattgtttaaacttactttatgagtgtttgtttagaagttcggaccaacagaaaaatgcagtcagatgtcatcttggaattggtttctaaaagagtaaggcatgtccctgcccagaaacttaggaagcatgaaataaatcaaatgtttattttccttcttatttaaaatcatgcaaatgcaacagaaatagagggtttgtgccaaatgctatgaacggccctttcttaaagacaagcaagggagattgatatatgtacaatttgctctcatgttttaaaaaaaaaaaggtaaatgtaacttaatagttttgtaaatgggagagggggaatctataaactataaatacagttattttattttttgtacatttttaaggagaaaaaaataaatattcataacataagagtaaaaaaca

SEQ ID NO: 414799 - DNA, 3562 bp, Homo sapiens
tattaaacagattagtcttttgcctttttaagagacagtttatgccttaggaaagtctgtacatcacgtaatattttttccatttcttgtctctgacctacagtaagcctattgttttgttccacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctaccacggagccgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctttctcacccctccatatctatatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcctgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgctgccatgtgagagctgtgaacagctcagctctgagtcggcaggctggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgtgcatgtttcctaagtccttgagcaatcatggtggtgacaattgccacaagggatatgaggccagtgccaccagagggtggtgccaagtgccacatcccttccgatccattcccctctgcatcctcggagcaccccagtttgcctttgatgtgtccgctgtgtatgttagctgaactttgatgagcaaaatttcctgagcgaaacactccaaagagataggaaaacttgccgcctcttcttttttgtcccttaatcaaactcaaataagcttaaaaaaaatccatggaagatcatggacatgtgaaatgagcatttttttcttttctttttttttttttttttttaacaaagtctgaactgaacagaacaagactttttcctcatacatctccaaattgtttaaacttactttatgagtgtttgtttagaagttcggaccaacagaaaaatgcagtcagatgtcatcttggaattggtttctaaaagagtaaggcatgtccctgcccagaaacttaggaagcatgaaataaatcaaatgtttattttccttcttatttaaaatcatgcaaatgcaacagaaatagagggtttgtgccaaatgctatgaacggccctttcttaaagacaagcaagggagattgatatatgtacaatttgctctcatgttttaaaaaaaaaaaggtaaatgtaacttaatagttttgtaaatgggagagggggaatctataaactataaatacagttattttattttttgtacatttttaaggagaaaaaaataaatattcataacataagagtaaaaaaca

SEQ ID NO: 414800 - DNA, 2199 bp, Homo sapiens
attggatcaaacatgtcacaagagtcggacaataataaaagactagtggccttagtgcccatgcccagtgaccctccattcaatacccgaagagcctacaccagtgaggatgaagcctggaagtcatacttggagaatcccctgacagcagccaccaaggccatgatgatcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcagaagcagaacaggaagaacgggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgaggtatctctcctgctggggcatgccctctcagaagggatgcggggtgtctctcccaagaagagcttgcaagccctcttgcccaggcccccatggctctgtgccagcctggtgactttctcttcacacaggaagtccacagtcttcttctttgctttaaactctgtcctttcaacaccttaagaaaacatttgtcattcctgggtgctggttctttcctttgccttgggagaacgtaatgaataaacagactcatccagcagcaaggtacaaggttaagaacgaaactcttgctgcgtgtgtggacagtcatacctcataagaactagtgattgagcctcatttgatacatgcaaactattcatctcacccaaataaatgagcctcaggtttctgtggcatcaccacttactcattttctcccagtcaaaggtcttattctgcttcaccaagagggtaagaaacaaagcttgactgtgcccatgtcttgcccagcatgtcaatgccatacaggattccatgcccttcctcggagtaagaggaaagtgtgtgggtgcacattcccctcagtatcctgc

SEQ ID NO: 414801 - DNA, 4932 bp, Homo sapiens
attggatcaaacatgtcacaagagtcggacaataataaaagactagtggccttagtgcccatgcccagtgaccctccattcaatacccgaagagcctacaccagtgaggatgaagcctggaagtcatacttggagaatcccctgacagcagccaccaaggccatgatgatcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcagaagcagaacaggaagaacgggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctaccacggagccgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctttctcacccctccatatctatatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcctgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgctgccatgtgagagctgtgaacagctcagctctgagtcggcaggctggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgtgcatgtttcctaagtccttgagcaatcatggtggtgacaattgccacaagggatatgaggccagtgccaccagagggtggtgccaagtgccacatcccttccgatccattcccctctgcatcctcggagcaccccagtttgcctttgatgtgtccgctgtgtatgttagctgaactttgatgagcaaaatttcctgagcgaaacactccaaagagataggaaaacttgccgcctcttcttttttgtcccttaatcaaactcaaataagcttaaaaaaaatccatggaagatcatggacatgtgaaatgagcatttttttcttttctttttttttttttttttttaacaaagtctgaactgaacagaacaagactttttcctcatacatctccaaattgtttaaacttactttatgagtgtttgtttagaagttcggaccaacagaaaaatgcagtcagatgtcatcttggaattggtttctaaaagagtaaggcatgtccctgcccagaaacttaggaagcatgaaataaatcaaatgtttattttccttcttatttaaaatcatgcaaatgcaacagaaatagagggtttgtgccaaatgctatgaacggccctttcttaaagacaagcaagggagattgatatatgtacaatttgctctcatgttttaaaaaaaaaaaggtaaatgtaacttaatagttttgtaaatgggagagggggaatctataaactataaatacagttattttattttttgtacatttttaaggagaaaaaaataaatattcataacataagagtaaaaaaca

SEQ ID NO: 414802 - DNA, 4846 bp, Homo sapiens
attggatcaaacatgtcacaagagtcggacaataataaaagactagtggccttagtgcccatgcccagtgaccctccattcaatacccgaagagcctacaccagtgaggatgaagcctggaagtcatacttggagaatcccctgacagcagccaccaaggccatgatgatcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcagaagcagaacaggaagaacgggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctaccacggagccgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctttctcacccctccatatctatatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcctgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgctgccatgtgagagctgtgaacagctcagctctgagtcggcaggctggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgtgcatgtttcctaagtccttgagcaatcatggtggtgacaattgccacaagggatatgaggccagtgccaccagagggtggtgccaagtgccacatcccttccgatccattcccctctgcatcctcggagcaccccagtttgcctttgatgtgtccgctgtgtatgttagctgaactttgatgagcaaaatttcctgagcgaaacactccaaagagataggaaaacttgccgcctcttcttttttgtcccttaatcaaactcaaataagcttaaaaaaaatccatggaagatcatggacatgtgaaatgagcatttttttcttttctttttttttttttttttttaacaaagtctgaactgaacagaacaagactttttcctcatacatctccaaattgtttaaacttactttatgagtgtttgtttagaagttcggaccaacagaaaaatgcagtcagatgtcatcttggaattggtttctaaaagagtaaggcatgtccctgcccagaaacttaggaagcatgaaataaatcaaatgtttattttccttcttatttaaaatcatgcaaatgcaacagaaatagagggtttgtgccaaatgctatgaacggccctttcttaaagacaagcaagggagattgatatatgtacaatttgctctcatgttttaaaaaaaaaaaggtaaatgtaacttaatagttttgtaaatgggagagggggaatctataaactataaatacagttattttattttttgtacatttttaaggagaaaaaaataaatattcataacataagagtaaaaaaca

SEQ ID NO: 414803 - DNA, 901 bp, Homo sapiens
attggatcaaacatgtcacaagagtcggacaagtaagtggatcacacgcgccggctgctgctactactaccactttgggctgatggcaactgtaataaaagactagtggccttagtgcccatgcccagtgaccctccattcaatacccgaagagcctacaccagtgaggatgaagcctggaagtcatacttggagaatcccctgacagcagccaccaaggccatgatgatcattaatggtgatgaggacagtgctgctgccctcggcctgctctatgactactacaaggttcctcgagacaagaggctgctgtctgtaagcaaagcaagtgacagccaagaagaccaggagaaaaggtaaaggaatttgcctggcccccagaataactctatgttttctaaaaaacaatgttattaaactgtatgttttgttcttgagaggagatggggtcaagaagcttagcatcatctatctgtcttttgagtctggaccaatgctagatctctcaatgaggagagcaaattgcatgtttggttgtgcatccaaagggtctctccaccctcttcagatacccctcttcagattccaaggaggcttaaaatcctgagtcagaggtgagatgctggtaagatagcccattgctgggattaacttttctgatcaatcctatggcattataactgcaattaggcccctcaggaagtgagacacttgaaggattgcttttgatgatcagggaaggggaaagaaaggaggttgggctctttctcagccaagggaggcataggtggaggcgactgtaagggctatcgctgtcagggtgaaggggcaggacagctgcaggagatcaccatggaacaccccttgtctgccctcctcaatcaagaaccagctgaaaagc

SEQ ID NO: 414804 - DNA, 392 bp, Homo sapiens
tgagccactgtgcccagcctcatttaatttcattcatacttgcaagatggaaaatattaatactatccctgcttgatgttgatgaagaaattgaaacactgagggatcagatgagtttctcaaagacaaacagttcatctaggggaaagccagagttctaatccataccctttcactcaacaatcaatgcctataccaacagtttaatacttagtctagaaacatgtctctgatttttacaatttattcatttattcattcatttgtttattttttaccttctaccagaagggtaactatgctaacaatgtaatatattgttttgaattgagttatattagttgcaaatactgagaatagaataatataaagaattttttaaatctgtttca

SEQ ID NO: 414805 - DNA, 2413 bp, Homo sapiens
gtcttattcctttttagtgtattggaccgagttccagatgggccagtatttattgctatgtgttttctagtgagagtaatggatgcagttagctttgctgcagcaatgactgcatcttcttctatcctggcaaaggcttttccaaataacgtggctacggtattgggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctcaaaaaaaaaaaaaaaaaaaaaaaaaaaaaaaaaaaaaaaaaaaagagagggggggggcgcgttaaagagttttcccgcgggggggcgcccaagttttaggggttccccggtttttttttgcaacaagggggcccacaagaggggagacgcgatattaaaaacgagacgacgcgggcgccggcgcggttacacacgcggtgcgggcgagggggaacaaagcgtctaccgtgggagcacctcgggaagaagcacacactcactcgggggagggggggacaaatatatggtgggggcaaacaacttctctctaacaagaagattcttataacacggccctaggaggggaaacatcttaacactttctgaacgctgttaatcagggggtttcaaaccacagcggacaaatgatcactgacggcttgaaaaaactttctggcctcacagggagctacatctcgagaaccaatttttttaccgag

SEQ ID NO: 414806 - DNA, 2026 bp, Homo sapiens
tgtcggggcaaatacactttattcagtcctggcatcagactggcggagtcctgctgtgggtgccagtgccccagacagagggaccccacccctcagctacgagactagttctccaagaccacagacagtgacatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctcaaaaaaaaaaaaaaaaaaaaaaaaaaaaaaaaaaaaaaaaaaaagagagggggggggcgcgttaaagagttttcccgcgggggggcgcccaagttttaggggttccccggtttttttttgcaacaagggggcccacaagaggggagacgcgatattaaaaacgagacgacgcgggcgccggcgcggttacacacgcggtgcgggcgagggggaacaaagcgtctaccgtgggagcacctcgggaagaagcacacactcactcgggggagggggggacaaatatatggtgggggcaaacaacttctctctaacaagaagattcttataacacggccctaggaggggaaacatcttaacactttctgaacgctgttaatcagggggtttcaaaccacagcggacaaatgatcactgacggcttgaaaaaactttctggcctcacagggagctacatctcgagaaccaatttttttaccgag

SEQ ID NO: 414807 - DNA, 1859 bp, Homo sapiens
ctagtaatcccttaaggcatgagacacattaaaaccactttattgagccataattcatatacaattcacccatttaaagtgtacaattcaatggatttttgtatattcacagagttatacattcttcaccacaattttattttattttgagagagtcttttcactctcatcacccaggctggagtgcaatggtgcgatcttggctcactgcaacctccgcctcccaggtccaagagattcttctatctcagcctcctgagtagctgagattacaggcgtgagccaccatgcccgggcagtagaaacttttttaaaaagatagttggatggagatacaggtactggttttttgtttgtttgtttgtttttaagatgagaaatattgagattcatctcttctttccctcaatgtaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctcaaaaaaaaaaaaaaaaaaaaaaaaaaaaaaaaaaaaaaaaaaaagagagggggggggcgcgttaaagagttttcccgcgggggggcgcccaagttttaggggttccccggtttttttttgcaacaagggggcccacaagaggggagacgcgatattaaaaacgagacgacgcgggcgccggcgcggttacacacgcggtgcgggcgagggggaacaaagcgtctaccgtgggagcacctcgggaagaagcacacactcactcgggggagggggggacaaatatatggtgggggcaaacaacttctctctaacaagaagattcttataacacggccctaggaggggaaacatcttaacactttctgaacgctgttaatcagggggtttcaaaccacagcggacaaatgatcactgacggcttgaaaaaactttctggcctcacagggagctacatctcgagaaccaatttttttaccgag

SEQ ID NO: 414808 - DNA, 2246 bp, Homo sapiens
gtcttattcctttttagtgtattggaccgagttccagatgggccagtatttattgctatgtgttttctagtgagagtaatggatgcagttagctttgctgcagcaatgactgcatcttcttctatcctggcaaaggcttttccaaataacgtggctacggtattgggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattacttggtataacgtttttcatttcctttaatgtctctgttttttggctctaccatctatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctcaaaaaaaaaaaaaaaaaaaaaaaaaaaaaaaaaaaaaaaaaaaagagagggggggggcgcgttaaagagttttcccgcgggggggcgcccaagttttaggggttccccggtttttttttgcaacaagggggcccacaagaggggagacgcgatattaaaaacgagacgacgcgggcgccggcgcggttacacacgcggtgcgggcgagggggaacaaagcgtctaccgtgggagcacctcgggaagaagcacacactcactcgggggagggggggacaaatatatggtgggggcaaacaacttctctctaacaagaagattcttataacacggccctaggaggggaaacatcttaacactttctgaacgctgttaatcagggggtttcaaaccacagcggacaaatgatcactgacggcttgaaaaaactttctggcctcacagggagctacatctcgagaaccaatttttttaccgag

SEQ ID NO: 414809 - DNA, 1831 bp, Homo sapiens
gtcttattcctttttagtgtattggaccgagttccagatgggccagtatttattgctatgtgttttctagtgagagtaatggatgcagttagctttgctgcagcaatgactgcatcttcttctatcctggcaaaggcttttccaaataacgtggctacggtattgggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcggatcagcctgatccgcttaagcagcctcatttcacagaggagaaaacagactcaatgaggtagccagtaagcagaagtcacactagtagccagaaacagagctgcgggcgaattgtgtcattccctctgtagagctcattttctctccacttaatgtgtagacacttgggtcagcagaagtgcccaggccctggcttcccttgtaatgcaccagtctcgg

SEQ ID NO: 414810 - DNA, 661 bp, Homo sapiens
agctttgctgcagcaatgactgcatcttcttctatcctggcaaaggcttttccaaataacgtggctacggtattggtatgtattttagaagtatttcccactttcctttgagtgtaggccaaaatatttgcccttccaagttaaagctggggtccattcttctatacttgcatttctctactctctgtattattgttgcctttcaccccgagtttgactagcagcaagcctgtcaataaatgtaacattggtttcacttaggtgctcttcctggttttagaattccctgaatgggcagtttgacaggtaaatgtggtccaaatcagtcgttctttttaccacttaaaaaaaaaattttcctttgtagtttttttgctgtctccccgtagcctagattgtggctgagctgcctgaagcattcctctgctttagaaaagagttatccctagtggcaaaataatcaattcatactaaaggccttcttccactttccccagatttatgcacgggatcttagaaatcatctcaaagtccttaagtgtttctgtgctgtctgtctgaggagtgcttttgcattttgacataaaaatccagatcctggtggcatgatattgacatgcgtttttgtgtactgcctagatgcgtatagacctggtattag

SEQ ID NO: 414811 - DNA, 408 bp, Homo sapiens
gtccaaggacgtggcttgaagccgggagctggggcgccggagtccacgcaccggggatggaggcgctgggtgacctggagggaccacgcgcaccaggaggtgaccatgaattgcgtggccgggagcccggagaccagcggcggcttccggcgtgtctctttagcaacgattgaattgcttatagcttgatctgtttccgagagattggaaaaggctggggcctgatcgtggggttcgggccagcgtttcttttctctctggacggggtaaagttccaggattggatatgtgtcacggtttctaatgactttctaacctatacctctgctttttaagtactgtgtgtttaatgcattcaaataagtatgccattaggcaaatgtaaaacgttacctttcaagtacccat

SEQ ID NO: 414812 - DNA, 658 bp, Homo sapiens
atttctagaaaaccatggagtaaatgtaactatgaaaattcttttaaataagatttgctttttatcttagaagcagagtattcttgctgttggtttttttccagattatccttggtttatcttaattgatctatcatacaattttttctttcacacaggttttccttttaataatggatacactcatgtctctttttgcagtgaaaatgggtttgaagagggattaagtacattgggacttgtatcaggtctttttagtgcaatgtggtcaattgggtgagtagtcatttaatttctttctttttttttttttttgagatggagtttcactctcatcacccaggctggagtgcaatggtgcgatcttggctcactgcaacctccgcctcccaggtccaagagattcttctatctcagcctcctgagtagctgagattacaggtgcccaccaccacatctggctaatttttgtatttttagtagagacagggtttcaccgtgttggccaggctggtcttgaactcctgacctcaggtgatctgcccgccttggcctcccaaagtgctgggattacaggcatgagccactgtgcccagcctcatttaatttcattcatacttgcaagatggaaaatattaatactatccctgcttgatgt

SEQ ID NO: 414813 - DNA, 2261 bp, Homo sapiens
gtggctccttggaggtcgagtccaaggacgtggcttgaagccgggagctggggcgccggagtccacgcaccggggatggaggcgctgggtgacctggagggaccacgcgcaccaggaggtgatgatcctgcaggaagtgcaggagagacccccgggtggctttcgagagaacaggtttttgtactgatatcggcagcttcggtgaacttaggttccatgatgtgctattctatacttggaccgtttttccccaaagaggctgaaaagaagggagccagcaatacaattatcggtatgatctttggatttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctcaaaaaaaaaaaaaaaaaaaaaaaaaaaaaaaaaaaaaaaaaaaagagagggggggggcgcgttaaagagttttcccgcgggggggcgcccaagttttaggggttccccggtttttttttgcaacaagggggcccacaagaggggagacgcgatattaaaaacgagacgacgcgggcgccggcgcggttacacacgcggtgcgggcgagggggaacaaagcgtctaccgtgggagcacctcgggaagaagcacacactcactcgggggagggggggacaaatatatggtgggggcaaacaacttctctctaacaagaagattcttataacacggccctaggaggggaaacatcttaacactttctgaacgctgttaatcagggggtttcaaaccacagcggacaaatgatcactgacggcttgaaaaaactttctggcctcacagggagctacatctcgagaaccaatttttttaccgag

SEQ ID NO: 414814 - DNA, 2455 bp, Homo sapiens
gtcttattcctttttagtgtattggaccgagttccagatgggccagtatttattgctatgtgttttctagtgagagtaatggatgcagttagctttgctgcagcaatgactgcatcttcttctatcctggcaaaggcttttccaaataacgtggctacggtattgggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatttcactctcatcacccaggctggagtgcaatggtgcgatcttggctcactgcaacctccgcctcccaggtccaagagattcttctatctcagcctcctgagtagctgagattacagtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctcaaaaaaaaaaaaaaaaaaaaaaaaaaaaaaaaaaaaaaaaaaaagagagggggggggcgcgttaaagagttttcccgcgggggggcgcccaagttttaggggttccccggtttttttttgcaacaagggggcccacaagaggggagacgcgatattaaaaacgagacgacgcgggcgccggcgcggttacacacgcggtgcgggcgagggggaacaaagcgtctaccgtgggagcacctcgggaagaagcacacactcactcgggggagggggggacaaatatatggtgggggcaaacaacttctctctaacaagaagattcttataacacggccctaggaggggaaacatcttaacactttctgaacgctgttaatcagggggtttcaaaccacagcggacaaatgatcactgacggcttgaaaaaactttctggcctcacagggagctacatctcgagaaccaatttttttaccgag

SEQ ID NO: 414815 - DNA, 1345 bp, Homo sapiens
gaacctggcatccccgactccctgcaggcagcgatccgcccggcccggagctccgcaaagccttccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctcaaaaaaaaaaaaaaaaaaaaaaaaaaaaaaaaaaaaaaaaaaaagagagggggggggcgcgttaaagagttttcccgcgggggggcgcccaagttttaggggttccccggtttttttttgcaacaagggggcccacaagaggggagacgcgatattaaaaacgagacgacgcgggcgccggcgcggttacacacgcggtgcgggcgagggggaacaaagcgtctaccgtgggagcacctcgggaagaagcacacactcactcgggggagggggggacaaatatatggtgggggcaaacaacttctctctaacaagaagattcttataacacggccctaggaggggaaacatcttaacactttctgaacgctgttaatcagggggtttcaaaccacagcggacaaatgatcactgacggcttgaaaaaactttctggcctcacagggagctacatctcgagaaccaatttttttaccgag

SEQ ID NO: 414816 - DNA, 1222 bp, Homo sapiens
gtcttattcctttttagtgtattggaccgagttccagatgggccagtatttattgctatgtgttttctagtgagagtaatggatgcagttagctttgctgcagcaatgactgcatcttcttctatcctggcaaaggcttttccaaataacgtggctacggtattgggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtgtgagtaatcagtcttttatttgcattttccttatatttgtggaaaaacttgacttggaaaatttacattaatcagtacttttaattgtgtttaagggattagccatgggcttgttttatctactggagtattcaaggagaaaaaggtatggtcaattttggggctttttttctctctttaaaagttagccagtgcaagtggaaaataaataacattttacatttattcttccagtcagtggatttctaagcactctgaggctcatcagttggtagatacttttttaatttttattttttgaga

SEQ ID NO: 414817 - DNA, 2075 bp, Homo sapiens
ggcacatagaagagtgagccatcatctggtttccagcgccaagacttctgcaggagagcctccgctgggctttcaagttggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggagcaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctga

SEQ ID NO: 414818 - DNA, 298 bp, Homo sapiens
cgcatttattttaatcaatcgaaaaccctgaagaaaggtcaaaaagctatcttgagagtcttttagattggtaatatttagtgtcatgcttccccaaggaatatagatacttctgaagtatttttttttgaaaatttatacagatagtagctgaatacaataggtatctaaaaccagtaaatgatgttgagaatgaatgaaatgattaatgtagccaaatatagtattaaacattaattttatacagaaagaaataggattggtacagagaaaaattaaaatgtacaagattttttaa

SEQ ID NO: 414819 - DNA, 343 bp, Homo sapiens
  misc_feature (7)..(7): n is a, c, g, or t
cattgtnagtcccttgctttacactgtagccatgtctgatagaaagtgtgtggagcttgtcacaggatcatggataggtggaatagttaacacattaatccacacaatcagcttgaggagactgtccttttgtaggctaaatgctgtcagccacttcttctgtgacattccttcactgctaaagctgtcatgttctgacacctccatgaatgagttgttgctgttaaccttctccggagtcattgccatggccaccttcttgactgtgatcatttcctacatcttcattgcttttgctagcctaaggatccactcagcatcaggcagacagcaagccttctcc

SEQ ID NO: 414820 - DNA, 314 bp, Homo sapiens
tttaaagaatggtagacctgctgtccctatattgatattctgtacttgtatagtaacatgttttatagtcagatgattaggccagatatcaaagccttcagtctttttccactacaaattctgctacatacagaaacacagatatattaataaatgataccttagagtctcactccttaatctaaatagctcggtgattcttcattcctacagaataaaattgtctcccaaactaaatttccagcttcattctcattattcccttttatttctaagatctaatcaaattggataagggagtgctctttaaaaaa

SEQ ID NO: 414821 - DNA, 864 bp, Homo sapiens
agaagaactcaaacctctggaggaagtgctaaatttagctcaaagcaaaaactttcacttaagacccagggacttaatcagcaatatcaacgtaatagttctggaactaaagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataagctctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttctatgattaaa

SEQ ID NO: 414822 - DNA, 248 bp, Homo sapiens
agaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgataattaagtgcttcccacttaaaac

SEQ ID NO: 414823 - DNA, 1043 bp, Homo sapiens
tcagctctatgctctgatgattgcttgctgcccttgggtcaggtgttcagttctggctgaattaatatggcctagaagcggggtggcaaatcacatggtacgcaacagggccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 414824 - DNA, 2819 bp, Homo sapiens
cagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 414825 - DNA, 2765 bp, Homo sapiens
cagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccatagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 414826 - DNA, 2765 bp, Homo sapiens
cagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcttagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 414827 - DNA, 2517 bp, Homo sapiens
cagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatgatgagtggccaactctggagcccaggatgttgcttcccagtctggtggtgaatcctccacaatctgagctggccctctggtgcccaaagcagactcctggggtccctgtattgggcacttacccacttcctgctggccgcagcatgacacctgatgctcctagagcagccaactgaattccagaagaaaggcttcagtggtgtgttttccagaaggaacctggctcctaggattaacagttgggtcaaatctcaaaaactctttgcccttaactgctgaaaactgccagcatctatagcagtcatagtcacaagatttcctttaaatttttcagcaattgttttcctaaggcattctgtaaagtctggcttgaagtttgtttagttgagataaaaatgtgtttgactgcactccagcctgagagacagagtgacatattgtctcaaaaataaataaacaaataagttttttaaaacatgtttgagaaccac

SEQ ID NO: 414828 - DNA, 2028 bp, Homo sapiens
  misc_feature (1969)..(1969): n is a, c, g, or t
  misc_feature (1971)..(1971): n is a, c, g, or t
  misc_feature (1975)..(1975): n is a, c, g, or t
  misc_feature (1991)..(1991): n is a, c, g, or t
  misc_feature (1995)..(1995): n is a, c, g, or t
  misc_feature (1997)..(1998): n is a, c, g, or t
  misc_feature (2002)..(2002): n is a, c, g, or t
  misc_feature (2013)..(2013): n is a, c, g, or t
cagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaagaaggcctgccatngnatgntctggatttctgccancccntnnttgntcacgtgcgtncccactacgctcttg

SEQ ID NO: 414829 - DNA, 994 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagaga

SEQ ID NO: 414830 - DNA, 1418 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaac

SEQ ID NO: 414831 - DNA, 1789 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtaagattgagatttgttagagctgaagctgcaggaaggaaagtgggaggaggctgtggacatgaatgtggttgaaagttgtaggggaattgggaagtggcatgatgatgacacaggagcccccttggacccatcgatctcatgtctgtcctgttgcaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaac

SEQ ID NO: 414832 - DNA, 1206 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagaga

SEQ ID NO: 414833 - DNA, 996 bp, Homo sapiens
  misc_feature (17)..(17): n is a, c, g, or t
ttttgacccgcagtgcnactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagaga

SEQ ID NO: 414834 - DNA, 770 bp, Homo sapiens
tacgtgtcattatctcggatctatcattcagagtagtccatgacgagctcgtatatcgaaattaggccccgacctgactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagaga

SEQ ID NO: 414835 - DNA, 819 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactggggtgttacctactaagagatgcctggggtaagccgcccagctacctaattcctcagtaacatcgatctaaaatctccatggaagcaataaattccctttaagaga

SEQ ID NO: 414836 - DNA, 1297 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaac

SEQ ID NO: 414837 - DNA, 990 bp, Homo sapiens
gtgatctcgaggatttgcccaggtagattagaacattgccttgcattgcactgacaaacatcgctgtgctaaaacataacttgaacatcgtgattaaacgctccaactctaccgctgctaccaatggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaac

SEQ ID NO: 414838 - DNA, 783 bp, Homo sapiens
gtcagaggattagcccaggtagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaac

SEQ ID NO: 414839 - DNA, 876 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatggagaggaaatgctggtaggaagactcttccaggatgtaatgcagaagaagctcagggcagagctattcacactttacaccagtgctgtttcctcaccatagaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactggggcctttttgactgggggcctgagaattcagacctttgcagttcctggggctgtgcctggg

SEQ ID NO: 414840 - DNA, 1216 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagaaacaacaaacagaaaaaaaaaacacacaagcaaacacaaagaaaaaaacactctgcggggagcatatctattgcggggggggcgcagcaaaacagagcgtatataaaagggcgcacaggggccaagacgtgttcccggacgcacccagtctctgttgcccacaagggtggaaaacccggggggccccccaaaggggagagcgcgattacatctcaaaacacg

SEQ ID NO: 414841 - DNA, 984 bp, Homo sapiens
agcatttggaactataaacgggtaaaaagggggtttcgctcgggttacgggatcagtcaaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagaga

SEQ ID NO: 414842 - DNA, 1630 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaac

SEQ ID NO: 414843 - DNA, 1086 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaagtgccattgcatttaccgggcccttataatgggctgtgttaatgactatccctcttttttgggcccaattattaaatatccttttttctcaaaatatttttccttaaccttttttttggaattaaacttgtttttcccctaagggttcaaaagtgctttaaattttttcctggaccccgggattttttttttttttt

SEQ ID NO: 414844 - DNA, 1243 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactggggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaac

SEQ ID NO: 414845 - DNA, 541 bp, Homo sapiens
ggctgaccttagaggacccgtgatgttatgcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagaga

SEQ ID NO: 414846 - DNA, 825 bp, Homo sapiens
ggcagggtttggtttgggtgtcttcagatttccttgtcttgaggtcctcacaattactctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactggggatggtgtccacccatgtgatctcctcatccttgcatagagtgtgccaggtctggttgtcaggtttcccagagtggagcagccggcgttggcagcgatgtctgtcggtct

SEQ ID NO: 414847 - DNA, 1336 bp, Homo sapiens
ggctgaccttagaggacccgtgatgttatgcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtaagattgagatttgttagagctgaagctgcaggaaggaaagtgggaggaggctgtggacatgaatgtggttgaaagttgtaggggaattgggaagtggcatgatgatgacacaggagcccccttggacccatcgatctcatgtctgtcctgttgcaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctcaaaac

SEQ ID NO: 414848 - DNA, 1093 bp, Homo sapiens
atgcaggccatgatccgggccatggagacgctgaagatcctctacaagttggagcagaacaaggccaatgcgctccagatccgagaggtggacgtggagaaggtgaccacctttgagcatcggtacgtcagcgccatcaagaccctgtgggacgaccccggcatccacgagtgctacgaccgcaggcgcgagtaccagctctcggactcggccaagtactgcgtgaccgacgtagactgcatcgccacctcgagctacctgcccacccagcaggacgtgctgcgggtccgcgtgcccaccaccggcgtctttcgacctggagaacatcatcttcaggatggcggatgttgggggacagcggtcggcgcagaggaagtggatccactgctttgagaacctgacgtccatcccgtttctcgtcgccctcagtgaatacgaccaagtcctggtggagtcggacaacgagaaccggatggaggagagcaaagccctgttccggaccatcatcgactacccctggttccagaactcccccgtcatcaccttcctcaacaagaaggacctgctggaggacaatatcctgtactcacacatggtggactacttccccgagttcgaagggccccagcaggacgcccaggcggcgcgggagttcatcctgaagatgttagtggacatgaaccccgacagcgacaagatcatcgactcccacttcacgtacgccaccgacacgaagaacatccgcttcgtgttcgcggccgtgaaggacaccatcctgcagctcagcctcaaggagtacaacctggtctgaaagcgcccaggcccagggagacgggacggagacaagggccgggacaaaccttccttcacacccaacccgcggctgccggccaggcagcgctgctgagcccgggcggggcctctgcccgcggaggatttttttttttttttaatatttttaacaaatggtttttatttcacagttatcaggggatgtatatctgtctgcacacttcgcgcaccttctcaccttttgtcaacgtcaaagggagtctttttctggccttgacttacggttcgcttttttctaaaa

SEQ ID NO: 414849 - DNA, 419 bp, Homo sapiens
ctacaagattctaacaatcagtgttaacaagaaatacaaaccatggctacaaaatatgggattttttcatttttctcccagaaaaattcccatgtatgtcaaatattgtcacacaaacaaaaagtatttgtgaattaacttaaaacacttgtcacaattaacttgacatgatctagatgataaccaacaaagtcttcccagggtgaacggcaaacattaaacaatgccaaatttccattctaattttaacatcataaccaatgtctttatttccaatattaccttgctgttttcatactttcaaaataaaactaataatcacgtaacaggccgggcgcggtggctcatgcctgtaggcgggtggatcacgaggtcaggagatcgagaccatcctggctactacggtgaaaccccgtctc

SEQ ID NO: 414850 - DNA, 591 bp, Homo sapiens
ccgctgtcaagatgcttctggccatggtccttacctctgccctgctcctgtgctccgtggcaggccaggggtgtccaaccttggcggggatcctggacatcaacttcctcatcaacaagatgcaggaagatccagcttccaagtgccactgcagtgctaatgtgaccagttgtctctgtttgggcattccctctgacaactgcaccagaccatgcttcagtgagagactgtctcagatgaccaataccaccatgcaaacaagatacccactgattttcagtcgggtgaaaaaatcagttgaagtactaaagaacaacaagtgtccatatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaat

SEQ ID NO: 414851 - DNA, 741 bp, Homo sapiens
ctatgctgtctttacaccacatgagctagcctggacctgcccacctatttgctctgtgtctcaagccacttcccttcccatccccacaatcctcaccaccgactctggctcttggcaggtaggcttctggggctgcttggctctacatcatttgagtcactctgtccttatcaactttcatccccacagtatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaatacatatgtggaaaaaacaacatgagctggtctcttggcaattattcatttcttgctgctcagaacaaagaaagctacaagtgttgttaaggggaagaatagatcagagactcctgtaggagtctctgtgataagactcctgatgctgaatacagaccctcaggctcataggctgtggctggagctgcaggagggctgcagggagcagttacaaagaatgtctatgaggaccatctgagggttgccactaggggaggctgaaggcatgtctgacactgctaagagggc

SEQ ID NO: 414852 - DNA, 284 bp, Homo sapiens
attattagtttatggtgctttaaacctatcaaaatagttgtaagtaaatggatttcttgttctcccaataacaattctctgagctaggatagatgtctttctggccattttacaggtgatgacactgacatagggactgagtgggtagcttaagttccatggttaccaggagcaggacccacgtttcctgtctcccagtctcatcctttttccactgaccaggttggttgctcccttggaaagcagtccctgagagttgacttagaagttcagggggaagaggt

SEQ ID NO: 414853 - DNA, 6177 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtgg

SEQ ID NO: 414854 - DNA, 621 bp, Homo sapiens
actgtgctatctaagttttgaattgtctttcctcttatcagtttcatgttatataagagcttgggatatccatatttaaatgtgctgtagaaatgaaggaaactttaaatattagcttataatttttcaaataaccctcttgttctggaattttaccatctctaaaatggaattagactgaatgtttttattttctgtttgtagattcattattttactaaagtgttgattttctttctgtagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagtaaggaaaccttgaaacttaagcaataaaataagataacctgatgagttgggaacaatcctgtccttttgagaaattactccccaagattaaaaaatagaaaataaacatattactgttagtttttttccaaaaagtaaatagtaactttggatattagaaaataatatatatcaaagcacgatgtaagctgataaaaaaaaa

SEQ ID NO: 414855 - DNA, 1489 bp, Homo sapiens
cggactttctttcgccaggctgtttcttacgccaggctgtttctttcgccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaataataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaatttcaaggctgtctttagtgttctgcccacaatactccaccaatgaccttagaccttgagatggtgctataacgctgcttatattgcagttaaccatagagaggtggagccacttaaaatgggcctattaccaaaattctccctggcatcattacagttcttggggatacactgattttagaaattactgtcagtatcctcctaaaagaaggcttaaatagtttctaacaagatgactatcaggaagctatgtggcttggggagttgggaccctctgcctcatattctgggtaactggtataacatagtaattattaggattgtatcaagtgtatctaaagatcaaaagggaaaaaaggcacccttaattgtcaaagttagttctaggaaaaaatactagcagggatgacaaactacgttcactttacagttaccataaattcttacttgggcccacccatttccatctgttaaggtccataaggttactcaagtttcagtggcttcattgttacaagaaaggggggaagtgagaaactttaataggctgtgatttagaaccactgctgattaacctttggccagtatgggtcagggaaggtgaacatgaaacactgcacagtaggttgtatcaatgc

SEQ ID NO: 414856 - DNA, 239 bp, Homo sapiens
gcggcgcctactactactactactgctcgaattcaagcttctaacgatgtacggggacatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtgg

SEQ ID NO: 414857 - DNA, 248 bp, Homo sapiens
cactgtgggaagtactgctcactcattaaacatcagagaattcatactggagaaaaaccttataaatgccgactaagtgatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacga

SEQ ID NO: 414858 - DNA, 6526 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414859 - DNA, 6669 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaaaactgagtactttagaagacactggagccttttctgtttcctgtagcagatcttactaaggactggttgctagaaatctgctagaacagtctttaagtatgataacgataaaactgtggattcagtatgtggggaaacctaaggttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414860 - DNA, 6221 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacga

SEQ ID NO: 414861 - DNA, 4602 bp, Homo sapiens
atagacactagaggatctccgaaaagtatcggccaatctaaatgtccatttagacgtactctgatacttcacataacccttatgacatgcgcctgcgttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414862 - DNA, 4055 bp, Homo sapiens
cgactctacgaggatcccctttacgctacgatcctgagcgagtcaagaataatcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414863 - DNA, 3893 bp, Homo sapiens
cttctacttctttttaaccacaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414864 - DNA, 3140 bp, Homo sapiens
acatcatagaggatcccccttcgaaacccagtagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414865 - DNA, 6886 bp, Homo sapiens
  misc_feature (5127)..(5127): n is a, c, g, or t
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggttgataaagttgcggggcaggggctgttttaaaccaggcctaaaatggtgttacaagtgattataatctataaataaaagtattggttttgtgaatatgagagctgactttaaggcaatttaagttaatggatttcttgattctaggggctctcttatgttaaggtcaaacttgtctggggaaaaaaaagcttttagcttatctcttctttgaaaattttaatttaaatgatacaactaggaggcttttttccccttgcaaaaccagatttatattggaaagnttccattgtttttcttggtttactagttcagtatgtggggtctaatgtttttgactttcactatttctttgaataggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414866 - DNA, 2862 bp, Homo sapiens
cctacactagtgtcactgccatcacatgtgacactgacactggtaatcactcaatgccgtagaaggcctcaatcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414867 - DNA, 6547 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggttgatgcaataaaggaaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414868 - DNA, 6483 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagagtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414869 - DNA, 6225 bp, Homo sapiens
  misc_feature (6192)..(6192): n is a, c, g, or t
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtgggacaaacacaacaanaacaaacccaataacaccaccagcgaaaaaaaa

SEQ ID NO: 414870 - DNA, 1707 bp, Homo sapiens
ggcggacctaagcagctatccaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414871 - DNA, 6473 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatataggctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414872 - DNA, 2594 bp, Homo sapiens
accttggccccccgtctcatgcagcacatttatgacattgaaaaccaccagtaatagataacattgagatttgaaatttagttttacttaggtataatgacagaccaagtataaggctttggttgagagaccagcttttaaatattgaaagacaaatatagtgtaaaaggcgcaatggaatttgtatagtgaaggagattctctagtcccagggttgtaatgtcacttctgtctaattcattacagaattacagaatcaaatcatgttagccctagaagaaactgcagatcattttgttcaatcttctcattatataggaaaggaaatttgagggccagtgcaatggtttgccaaggtcacacaactagttagtggaaggatccaggcattctaattcctttctttcactaatacatttggcctgctctacagaattacttctgtctgatactatccactttgaagagtagctagcatatagtagccatttacttttggctcaattaaaagcaaacatttttgggacaaaatcaggctttcctgattacttcttagataacagagcccacacagtattaaaacatgcagcctttctttatgcaaaaagattgaatatggagccacttgaatcttaaacttcagtctgcagctataaccaatatcatcagaagttatacacaattggcaaaagaatagcttattctgcccaaatacttgtccagtcactaggatcatttcacttttttgaataccatttgctttggggagggaagtattgccagaccgtgaattcattattacctctgatcagttttaaacttcatttgaaaagtggttccttctcgttttctccctccctcaggctgcatcctagcatgcccagttttagtctggcatgagcttttatggcattttgaatccctccttcctgagggtttataatgacagtgctgaaaaccacctggactgaagtatgaacattgccattgaatttgagggggactgagaatgttctttctagtctgttttattttgacagaatttaacatactaaggcttttccactttctgccataaacctaggtttataatacttttggggtgctaattaacatgatgtgtttttctccaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414873 - DNA, 5985 bp, Homo sapiens
  misc_feature (5813)..(5814): n is a, c, g, or t
  misc_feature (5817)..(5818): n is a, c, g, or t
  misc_feature (5823)..(5823): n is a, c, g, or t
  misc_feature (5826)..(5826): n is a, c, g, or t
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaagtcgnnacnngccgnttnatgggggaagcccaactggggtccctgtcattaaagcggttgggcgccacataagggccttgtgtcagcgtgggggcaccaagaaacccacatggttacaccggtgtggggtatgaacaacaaccttgggtactgcaaacacccctcgtcgctctgttg

SEQ ID NO: 414874 - DNA, 1308 bp, Homo sapiens
gaagacggtcgaacttgactatctcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414875 - DNA, 1300 bp, Homo sapiens
cggacgcgtgggtcgacccacgcgtccgcgaccacgcgtcggacccacgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414876 - DNA, 1203 bp, Homo sapiens
tgattgcatttagactgattgcatttaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414877 - DNA, 1132 bp, Homo sapiens
cgagcggccgcccgggcaggtacgcgctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414878 - DNA, 6474 bp, Homo sapiens
  misc_feature (5127)..(5127): n is a, c, g, or t
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggttgataaagttgcggggcaggggctgttttaaaccaggcctaaaatggtgttacaagtgattataatctataaataaaagtattggttttgtgaatatgagagctgactttaaggcaatttaagttaatggatttcttgattctaggggctctcttatgttaaggtcaaacttgtctggggaaaaaaaagcttttagcttatctcttctttgaaaattttaatttaaatgatacaactaggaggcttttttccccttgcaaaaccagatttatattggaaagnttccattgtttttcttggtttactagttcagtatgtggggtctaatgtttttgactttcactatttctttgaataggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtaatgactcttctaagtgtattcagaactagtttccttgcatgtaaaattctacatgcacattaatttttttaaatgcttttttctttagtagaagtaagtcatttagtcgatcataaaatattcctgttcttttgaaatttttttttaatagctgacaaatgacactgattggaaggggaactcaaatgtagctgtttaccctcagtgtatttatgagggtgaaaataatctatgtatttttttatttaaaaaactttgataaattttatttcaaaatagtatttttctcaaaatcagttcttgtaactcaaatattcatgactagtattgtagattcccttttatttggttggttcctgactttaatgatgtctatgcctgtttcccctggggaagctgcatgtatattcttaacatccttttaatcttcacaatttttttgatagtttaacccctgatttaaaaataccataggaggtgaacatgggaaaaaaaaaacaagctgggggtctaattgccttataacattcactattcgtcttagtgtccttttttgatgtatgaatttactcaccctatcttcagcagttactagctgtctctctgtagaacatttttaaatggttttagaggatccttttcgtcaaagcaaaaaacatgattaaaatcagagtctcacatctgattccttcagcctgcctgagttggggggatgggagggtgaagaagcgctaccaacaacccctcccatactgaatttttcctcaggataccatttaattagataccattgtgtctgtttaaagtttttaaagaattaacattttctgtattcaatgtaagagaaaaaacatgttgccttatcttagccatagatgagaatagcttcttaaacataatgccaacttgtgagacctgtctttaagctgctgttaacctaagtgctgtaaatttttctagtgattaagctgctttctttcatactgtagcataaattcttctgcattaagctttgaagttacacaaaattctaaattttgcttcca

SEQ ID NO: 414879 - DNA, 5551 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggtaaaaccttttgattcttgcacataatctcaagactcataaagttatgttttcccattttttaaaaaagccattatcctttaggattgtaaacagtaggtgcttgcatacctaggatctaaatttagtaagatttcaggattgataaatcttctaattaagtgccaagttttcagaattttgctcagatcttgtataagatactgcttttgaaaaaaatgatatgattactttatctctaacatctagattgtaggtagagtcaaaaatgtctttgaccacttaactaattcataaaatttatttggtattaactatatttattcaccatttttcttgcctactgttttattagtgtttgtataaactttctcttatgaaggatttcacaagcaaaagtgaagtagagttaagcttaagctacttgcctttttttctctctcttcattttctttgaggctcagcgcatgcagatctgtactgctgccatgctgagttttatcagaagtttctctagagcacagaatcttgccctccatgccaggcgtgagccactggcccagccttgaatatgtaattttctgattgctgctttttctccccaatgcaaattatctcaaatatggataattattacatatagacatattagttcaatatgattcttttctccataactatgaccttttgagtccggctaatcaatttctgacgtggagtagcggaccagtctcttatgatataatccgatgctgcacttttgttcaaagtaaattccgctttgggtgccgtgcccgtcggggcgaaagcttgccatagggtgattatcctgacctaagacttaacaatttcaacttagggtattgcaaaaaagcttct

SEQ ID NO: 414880 - DNA, 4678 bp, Homo sapiens
  misc_feature (4598)..(4598): n is a, c, g, or t
  misc_feature (4638)..(4638): n is a, c, g, or t
  misc_feature (4643)..(4643): n is a, c, g, or t
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaacagtacactgggaaacgtattgcgtcagtcanaaccatacacaaatctgtgaatgatcatgacatctttatncaganaagatacaggcctgcacacataatctatgcacttg

SEQ ID NO: 414881 - DNA, 4230 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcaaggcaggagagctgagcaagacaggagacctgatcagccaggagacctgagcaagccagg

SEQ ID NO: 414882 - DNA, 3851 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttataaggggcgttaacccaatggtccgagctcgaatcgtaacctggc

SEQ ID NO: 414883 - DNA, 3540 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcattaattgagcatattggaaacttggatcgtagattaggtccgagctgtt

SEQ ID NO: 414884 - DNA, 3378 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaactctatctactgcatagctgacgtaccgtgtatgagaatacgctgatatagagcaactatcaga

SEQ ID NO: 414885 - DNA, 3135 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtgagtactgctagctgaatatgtagagaagctgcatttttaaaaacctgttacatgagagtttcagggtaattttaggtaatatgggacatttggggacg

SEQ ID NO: 414886 - DNA, 3482 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtaagtaatatgtaggtaatgtaaaggtataatcttactatagattttatttctcatattctggaaatccttttgaaactctgtgctcaataagagtggtctgcagcttttaacgtggggattttttgtttttgtttttgttttggagacagggtcttgctctgtcacccatgctggaatacagtggcacaatcacagctcactctaaccttaaactcctgggctcaagcagtcctcctgccttagcctccaagtatctgggactgcaggtgcatactaccatgcccagcctgcttttaatactttttccccagcagaatcctttcttggaataaaattctacgtgcttccctagcaagccgactcagggaagggggaaaaaaaaaacatgcatgccaagtgtgtaaaatataagaatagaactgctattattgaaaaagttgggtggcctagggccttactaacttgatagaccctgaggtatccatgtagactccaaagcagagttttcaaaccatcttaaatacagatattagataattcaccttctaactgtagaaacaggcagtattgctataatgggagcctttttattagacagtcttgcatagtcatctttgactgtatcttctttggacttatttatcatatggaacaatgtttcggtaactaaccaaaccggtagagacagaatatagtatatgtgctttcaatacttattaaaccatgaagtcttgtttttagctggacttcctgctaaattcctctatctagttgcaaatttagaccctcagtttattactgaatttaaaaactgaacttaaag

SEQ ID NO: 414887 - DNA, 2472 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagctcgcccctgagttagcagctcgcccctgag

SEQ ID NO: 414888 - DNA, 2340 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgacaatcacatcatggggtcctctaggtcgcc

SEQ ID NO: 414889 - DNA, 1317 bp, Homo sapiens
  misc_feature (262)..(262): n is a, c, g, or t
cgttgtgacggcgactcgtgttttgttgtcgctgtgcgttgcgctcgtgtgtccgcccctgtcggggttcatccgcgcgctggccacattttgggtgcttcttcggcaatcgggtttacccctcttgtcactgcaacccggggggttgtcaaccaccagtgggatactgggtctttcgtcctgatggttggtcccccagacagcccggttcgccccacctaaggggccctgttacatatgacgggggccacctgtctggcantgttctatagcaatagtgggggaaccgcattggtttagaggccttttgacgctcattttcgagattcaggccaacgtgtcggtgaacatgtgttcaatgaatctggggagcctgccatcccgtgtacgatcgtctgattagtgttgtcttttgttggcactgacagtcttgcatggtcaatatgccagggtttttgctcttagcttttcttttggataaaacagatcttaaatgcatgttagaccatacgtagtttgtaagctggttacatacactaaattttaagagagttccatattagagtgttctttgtttcgtttaaacactacagagtgccaatcaggttcttcacacagattgatattgagcagttctttaaagaaagagggggaagataaaagccccagtgttatacaacacttggaactattccccttcgaaataaattctaaaatgatgtggaatgtgaaataaggtgtttaacatacggtgatcccagttgtataggcttagtctccaagtatgcagtccttcctgacatagcaggcgactagtacatccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414890 - DNA, 1407 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggtacgctgatccgcttacgggaagaaacgccacagacgaaaatggctaaattcgtgatccgcccagcaactg

SEQ ID NO: 414891 - DNA, 1411 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagtaaggaaaccttgaaacttaagcaataaaataagataacctgatgagttgggaacaatcctgtccttttgagaaattactccccaagattaaaaaatagaaaataaacatattactgttagtttttttccaaaaagtaaatagtaactttggatattagaaaataatatatatcaaagcacgatgtaagctgataaaaaaaaa

SEQ ID NO: 414892 - DNA, 998 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacaggtaacattttaactatttttttatgaagaagaggtttagaacacggttgtgcccagaatgcagtttgattttgaaattaggtctttctatactcaatcctgttgaatttcacttattttggaagactttttttttccttcctcccatcccttctcttctccttcctccctcccttctcttcttcctcgctcccttgctatactgacatataatttcagaatgctcttaccaagcgttttta

SEQ ID NO: 414893 - DNA, 790 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtagaaagtgaccgggatcctcta

SEQ ID NO: 414894 - DNA, 719 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccatctatactcatgaagacgccatctatactcatgaagacgccatctat

SEQ ID NO: 414895 - DNA, 301 bp, Homo sapiens
tggataatcttataacattgaaccaggggtatgaaagacagtgactaaatatttactccagatggtaaagatttgaaacttcctaacttgatgttaatagatggattcattcctttaagattgacctaagagattgatctctacagggtgtttagtgtgatgtttggatcactttcgaagagcgtttaacatttctccttcttacactttcgaagagcgtttaacatttctccttcttaaagggaattcttcgtactccagacactatccgtcggttccagagtgtcccagcccagccagg

SEQ ID NO: 414896 - DNA, 361 bp, Homo sapiens
aaagtaggagagcaggcccaggtggtaatcattgatatgaatgacccaagtaatccaattcgaagaccaatttcagcagacagcgccatcatgaatccagctagcaaagtaattgcactgaaaggtataaaagaatgtgggttttccttaaaactcttcctatgtttttgtttttttttgttttttttttgtttgtttgtttgtttttgagacggagttttactcttgtcacccaggctggagtgcaatggcacgatcttggctcactgcaatctccaccccccaggttcaagcgattctcttgcctcagcctcccgagttgctggaattacaggtgcctgccaccacaaccagctagttt

SEQ ID NO: 414897 - DNA, 438 bp, Homo sapiens
agtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccaggtgcggccgggcccgggctggtgagggctgtggagaaggtggtaggaaggatggaagacgctggagtctgggcccgagcagtatcggagctggaggggcgggggggttgtcggtgattggggtaggtggaggagggggcactatcttggaaagcttaaaatattaaatgat

SEQ ID NO: 414898 - DNA, 277 bp, Homo sapiens
cacttgagcccaaggctgtagtgcacaatgattgtggctgtgaatagccactgcacttcagcctggacaatgtagcaatactcggggggcggggaaaaagtatgtgaaagcacattatagaccataaggtatttacatagttagcatgtcaagagtgtgttatttataatacagtatgtgtgtgtgaggtttttttccttttttcctagattgaaactgcttctgccttggctagaggccagaattcatgagggctgtgaggagcctgctactcaca

SEQ ID NO: 414899 - DNA, 522 bp, Homo sapiens
gctgattttaagttaagaagtatcaaatctacagtgagagatgaagtgacaaataattataaatcctgctaaagatgacaaagcattctaattatttcattacttgatgaatctgagagtttttgatttatgggtcttcaaacgttattctctttgatcctttatagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaaggtaagttttggctttggtaattattttaatgagaacttgtatttggctttctgctatgaattagtcatctaatttcaaaatagccttctcccttcctaagtaattttagtattcacatttgtggtgacttaatttgttcaaattttgcatctagtgatacttgtctaaaatgaataatgttctttcacaactc

SEQ ID NO: 414900 - DNA, 338 bp, Homo sapiens
attgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggtaagtggttttgagtaatgtgttttctggttggattccaggttagcagttctacaagggtttggtcatagttcaaaaatattttttccctaaatgtgaagttgttagcattcttaagttgtgtgctggattatttcttccaaacataatattctgtggtttcctttgaaatacggaaggaaattggtgagtaagaa

SEQ ID NO: 414901 - DNA, 377 bp, Homo sapiens
tcattttctttgaggctcagcgcatgcagatctgtactgctgccatgctgagttttatcagaagtttctctagagcacagaatcttgccctccatgccaggcgtggtgactcacgcctgtaatcccagcactttgggaggccaaggcaggcggatcacgaggtcaggagatcgagaccatcctggctaacacaatgaaaccccgtctctactaaaataccaaaaaaattagccggttgtggtggcacgtgcctgtagtagcagctactcgggaggctgaggccggagaatcgcttgaaccctagaggcaggttgcagtgagcccagattgcatcaccactgcactccagcctgggcaacagagggagactccatctc

SEQ ID NO: 414902 - DNA, 602 bp, Homo sapiens
taaaaagtcttttaaaaaattcttttattgtgctgattttattgtgtcatgaagtgtaatatgcatgtaggtatgtgtcaagtatacagagtgtcaggcatacggtgttcagtcataagcagttctggcctttggccctgcactgtttgttggctttttaggtaggaaccttcttagagtaagactgtcatgctaaaattgtagcaatcaaatgtgccccccatacaactcatttgaggttgagattatgttgctagagtggaggagattggagtgttctaaatgctaacagtttgtcctgcctccttgcccctgccccctgctcctttttgttttcttctactgtagggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttt

SEQ ID NO: 414903 - DNA, 752 bp, Homo sapiens
  misc_feature (716)..(716): n is a, c, g, or t
  misc_feature (732)..(732): n is a, c, g, or t
  misc_feature (741)..(741): n is a, c, g, or t
cgactctacgaggatcccctttacgctacgatcctgagcgagtcaagaataatcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcanggacccccttgaaagnaaaaaaggnttttggttccc

SEQ ID NO: 414904 - DNA, 6459 bp, Homo sapiens
gtaacatgtcgaggctactaaaaggacaataaagatgatttgtggataagtgcattacgcccattcagtgagtgagaatcttccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414905 - DNA, 8362 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagtttgagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaataataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaatttcaaggctgtctttagtgttctgcccacaatactccaccaatgaccttagaccttgagatggtgctataacgctgcttatattgcagttaaccatagagaggtggagccacttaaaatgggcctattaccaaaattctccctggcatcattacagttcttggggatacactgattttagaaattactgtcagtatcctcctaaaagaaggcttaaatagtttctaacaagatgactatcaggaagctatgtggcttggggagttgggaccctctgcctcatattctgggtaactggtataacatagtaattattaggattgtatcaagtgtatctaaagatcaaaagggaaaaaaggcacccttaattgtcaaagttagttctaggaaaaaatactagcagggatgacaaactacgttcactttacagttaccataaattcttacttgggcccacccatttccatctgttaaggtccataaggttactcaagtttcagtggcttcattgttacaagaaaggggggaagtgagaaactttaataggctgtgatttagaaccactgctgattaacctttggccagtatgggtcagggaaggtgaacatgaaacactgcacagtaggttgtatcaatgc

SEQ ID NO: 414906 - DNA, 8308 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagtttgagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaataataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaatttcaaggctgtctttagtgttctgcccacaatactccaccaatgaccttagaccttgagatggtgctataacgctgcttatattgcagttaaccatagagaggtggagccacttaaaatgggcctattaccaaaattctccctggcatcattacagttcttggggatacactgattttagaaattactgtcagtatcctcctaaaagaaggcttaaatagtttctaacaagatgactatcaggaagctatgtggcttggggagttgggaccctctgcctcatattctgggtaactggtataacatagtaattattaggattgtatcaagtgtatctaaagatcaaaagggaaaaaaggcacccttaattgtcaaagttagttctaggaaaaaatactagcagggatgacaaactacgttcactttacagttaccataaattcttacttgggcccacccatttccatctgttaaggtccataaggttactcaagtttcagtggcttcattgttacaagaaaggggggaagtgagaaactttaataggctgtgatttagaaccactgctgattaacctttggccagtatgggtcagggaaggtgaacatgaaacactgcacagtaggttgtatcaatgc

SEQ ID NO: 414907 - DNA, 6333 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaaaaaaaagggggcggtaaaaaatactcgagggccaagtacagtaccaggtttttgtacaagtggcctaaagagaggttaaagagagggggggttaaagggatgggaatgg

SEQ ID NO: 414908 - DNA, 3016 bp, Homo sapiens
gactctaaggatccccgtaagcgagatgttcacgaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414909 - DNA, 2888 bp, Homo sapiens
caagcagtgtactctcacatgagtgttcagcgccatactagtgaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414910 - DNA, 6472 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414911 - DNA, 2172 bp, Homo sapiens
ccggaccggcatactggaccttctcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414912 - DNA, 1725 bp, Homo sapiens
aagcgcacgatggcgcgtcccaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgta

SEQ ID NO: 414913 - DNA, 6065 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttgggaaaagtaggaccgagctcgatttacatggtgg

SEQ ID NO: 414914 - DNA, 6114 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtaatgactcttctaagtgtattcagaactagtttccttgcatgtaaaattctacatgcacattaatttttttaaatgcttttttctttagtagaagtaagtcatttagtcgatcataaaatattcctgttcttttgaaatttttttttaatagctgacaaatgacactgattggaaggggaactcaaatgtagctgtttaccctcagtgtatttatgagggtgaaaataatctatgtatttttttatttaaaaaactttgataaattttatttcaaaatagtatttttctcaaaatcagttcttgtaactcaaatattcatgactagtattgtagattcccttttatttggttggttcctgactttaatgatgtctatgcctgtttcccctggggaagctgcatgtatattcttaacatccttttaatcttcacaatttttttgatagtttaacccctgatttaaaaataccataggaggtgaacatgggaaaaaaaaaacaagctgggggtctaattgccttataacattcactattcgtcttagtgtccttttttgatgtatgaatttactcaccctatcttcagcagttactagctgtctctctgtagaacatttttaaatggttttagaggatccttttcgtcaaagcaaaaaacatgattaaaatcagagtctcacatctgattccttcagcctgcctgagttggggggatgggagggtgaagaagcgctaccaacaacccctcccatactgaatttttcctcaggataccatttaattagataccattgtgtctgtttaaagtttttaaagaattaacattttctgtattcaatgtaagagaaaaaacatgttgccttatcttagccatagatgagaatagcttcttaaacataatgccaacttgtgagacctgtctttaagctgctgttaacctaagtgctgtaaatttttctagtgattaagctgctttctttcatactgtagcataaattcttctgcattaagctttgaagttacacaaaattctaaattttgcttcca

SEQ ID NO: 414915 - DNA, 4851 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgctcgctgagcaataccagaccacgaagaaatttaatacctgagcagaccaatattgagttccaaaactgaatcagtaataaaaaagcctacaactaagaaatgcccagaccagatagtag

SEQ ID NO: 414916 - DNA, 2565 bp, Homo sapiens
ggcacgaggcaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggtgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccttcgcccgcctgggcagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcaccgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacaggcagacaaaccctctgatctatgaagtctctgcagggcaaggggaccagggacctggaaccctcttggccaaggggagtgggagagacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccacgtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaacagctgctctcaactccccacctctgggcactgaggagtatttcccctcattctacctctctaaggctatgcacccctccccacgtcttccagctgggggatggggggagtcataggaaaagcccccatctcccatctgggatagggaccttccatcagccttaaccctgggaaatgcctgctgcccccagtgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 414917 - DNA, 3122 bp, Homo sapiens
ggcacgaggcaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggtgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccttcgcccgcctgggcagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccaggcaagtgatccgggccctgaggggaggggaggtgcacagggaggggacgtctgctccagggcgccaccgaaggcgctgtggctgccggtcggcctggaacaggtgctgcacagcctgcagccatgtgtggccaccaagacagatgtggccacagggacagatgtggccatgaaaacaggtgggcctctaaggaacagttgtggccctgggggttggacatggttccatggccacccatgctctgtaaccacagccaatcccagctggagccctggagggctggatgggtgagcggtggggggcagcccccaggctccaggcctggggtggggttgttacagacctagcctcatatacacacacactgtgctgggtgaggccccacccccaccccagaaaaggtgggctgtaggaatgaggaggaacttagggagaaacagctaggggggaggtagggcctgggggagccgccccttgccccaagagaaggagccagaacccccggatctgcatgcaaggcctgctccatgcctcgctcacagcagcccatcccacagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcaccgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacaggcagacaaaccctctgatctatgaagtctctgcagggcaaggggaccagggacctggaaccctcttggccaaggggagtgggagagacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccacgtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaacagctgctctcaactccccacctctgggcactgaggagtatttcccctcattctacctctctaaggctatgcacccctccccacgtcttccagctgggggatggggggagtcataggaaaagcccccatctcccatctgggatagggaccttccatcagccttaaccctgggaaatgcctgctgcccccagtgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 414918 - DNA, 2628 bp, Homo sapiens
ggcacgaggcaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggtgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccttcgcccgcctgggcagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcaccgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacaggcagacaaaccctctgatctatgaagtctctgcagggcaaggggaccagggacctggaaccctcttggccaaggggagtgggagagacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccacgtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaacagctgctctcaactccccacctctgggcactgaggagtatttcccctcattctacctctctaaggctatgcacccctccccacgtcttccagctgggggatggggggagtcataggaaaagcccccatctcccatctgggatagggaccttccatcagccttaaccctgggaaatgcctgctgcccccagtgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacagacttctggaggccgcctgcctggagttctcaaacttagggcagggctggaaaccctgagagaaa

SEQ ID NO: 414919 - DNA, 1299 bp, Homo sapiens
ggcacgaggcaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggtgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccttcgcccgcctgggcagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcaccgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagcccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 414920 - DNA, 2816 bp, Homo sapiens
  misc_feature (2599)..(2599): n is a, c, g, or t
  misc_feature (2609)..(2609): n is a, c, g, or t
  misc_feature (2611)..(2611): n is a, c, g, or t
  misc_feature (2625)..(2625): n is a, c, g, or t
ggcacgaggcaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggtgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccttcgcccgcctgggcagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcaccgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacaggcagacaaaccctctgatctatgaagtctctgcagggcaaggggaccagggacctggaaccctcttggccaaggggagtgggagagacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccacgtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaacagctgctctcaactccccacctctgggcactgaggagtatttcccctcattctacctctctaaggctatgcacccctccccacgtcttccagctgggggatggggggagtcataggaaaagcccccatctcccatctgggatagggaccttccatcagccttaaccctgggaaatgcctgctgcccccagtgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacagaaaaaaaaaaaaaacaaaaaaaaaaaaaaaaaaanaaacaacaananaaaaaaacaaaaanaaaagaaacaaaaaagacaaccgaaccggcggcggactatatcaggcgggggggagcgcaaaggaacgaatagcgacaaagcagcgcagggggcaaacgggggcagcggacaccacattattgacaaaagggggaggaacaaggcgggcccccagagggggggccgtaataggcgacccgggaacctcgaa

SEQ ID NO: 414921 - DNA, 2990 bp, Homo sapiens
ggcacgaggcaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggtgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccttcgcccgcctgggcagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccaggcaagtgatccgggccctgaggggaggggaggtgcacagggaggggacgtctgctccagggcgccaccgaaggcgctgtggctgccggtcggcctggaacaggtgctgcacagcctgcagccatgtgtggccaccaagacagatgtggccacagggacagatgtggccatgaaaacaggtgggcctctaaggaacagttgtggccctgggggttggacatggttccatggccacccatgctctgtaaccacagccaatcccagctggagccctggagggctggatgggtgagcggtggggggcagcccccaggctccaggcctggggtggggttgttacagacctagcctcatatacacacacactgtgctgggtgaggccccacccccaccccagaaaaggtgggctgtaggaatgaggaggaacttagggagaaacagctaggggggaggtagggcctgggggagccgccccttgccccaagagaaggagccagaacccccggatctgcatgcaaggcctgctccatgcctcgctcacagcagcccatcccacagcccgccccggtggggcaggcaacatcaagaccctaggagacgcctatgagtttgcggtggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacaggcagacaaaccctctgatctatgaagtctctgcagggcaaggggaccagggacctggaaccctcttggccaaggggagtgggagagacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccacgtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaacagctgctctcaactccccacctctgggcactgaggagtatttcccctcattctacctctctaaggctatgcacccctccccacgtcttccagctgggggatggggggagtcataggaaaagcccccatctcccatctgggatagggaccttccatcagccttaaccctgggaaatgcctgctgcccccagtgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 414922 - DNA, 2018 bp, Homo sapiens
ggcacgaggcaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggtgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccttcgcccgcctgggcagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcaccgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacaggcagacaaaccctctgatctatgaagtctctgcagggcaaggggaccagggacctggaaccctcttggccaaggggagtgggagagacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccacgtggggttgggggtggggctggtccttctccctcccacaggcctgtgttcttggggctgctcccatgcagacaggatcacctaacagagatggaagccagggcatggatggggctttcccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 414923 - DNA, 1216 bp, Homo sapiens
cagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggagctgcacagtaaaggtcccaaaatacacaccaccacgagtgcaaaaacccaggcggttctcccaacgcgatgtttttttcccagcgaatctccgataagaaggtctgtgcagatttctgtgctcctacctgcagtaaatattcgtagacgtataaagctaacttttccccagcctgcccgtccgagggcaccaaggagcctttgcctttggcaaacatggtttgcagggaagagggcgcccagcctccccacagccgccaccgctccggctctcccgagctgcccctcgcccccggccccctcccaggcgctccctccctctctcgctggctggcgctctcctagcagcgctcccctccctcccgagcaggcgctggctccgcgctctttccagctgtcaaagcatcaggcccggccgcggccccatcgccctggaactcctcccgtgccggcttggcctggggtgccgccgccgcctcccgcaaggccgcccgctctccggtagctcgcgtgctcgcccggttccgcttgcgcggccctctgcgcccccagcaccgctgccgccgccgccggcgctggcctcatgtgtcacattttcttaatccagtctatggctgatggatatttgggttggttccaactttttgctattgtgaatagtgccgcaataaacatacgtgtgcatgtg

SEQ ID NO: 414924 - DNA, 650 bp, Homo sapiens
cgtacaggactaagcaatctcatcctgttctcagcaaacacctgtcgctgtacaacaatggttatcaccttcttggcttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttgaaaatggcaataagatcctcgt

SEQ ID NO: 414925 - DNA, 3846 bp, Homo sapiens
cagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414926 - DNA, 3835 bp, Homo sapiens
tcggcttacgtgctacgaggccctgggttgcatcggccgaggcgagatcgccgtgcgtcttgttgttctccacgctgttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414927 - DNA, 3870 bp, Homo sapiens
cagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggtagggagaaccctgagcctccagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414928 - DNA, 3888 bp, Homo sapiens
cagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcagagaccatcctcatgacacgtcattgcactgcagtttccaggggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414929 - DNA, 4282 bp, Homo sapiens
ctcaagtgatccacctgcctcagcctcccaaagtgctggcattacaggtgtgagccatcaagcctggccagccagcctttgaaccattaaaggaatagaggatcaaggaggaaagttaacgctattaatacctgagcagtttgaaagctacttagctactaggcattatagctgtgaagcatggaagagagcaaacagtatatttccagttgtaaattttaatcttgcaaattaaatactaaatttgtctgtggtttgtttttttgaagttttcacctctaacataaatatttattttttctctataaagacatgcagtaaaaaagagtaggccgggccgggcgtggtggctcatgcctgtaatctcagcactttgggaggccgacgcgggtggattacgaggtcaggagatcgagaccatcctggctaacacggtgaaaccccgtctctactaaaaatacaaaaaattagccaggcgtggtggtgggcgcctatagtcccagttactcaggaaactgaggtgggagaatagcttgaacctgggcggtggaagttgcagtgagctgagatcatgccactgcactccagcctggggacagagcaagactccttctcaaaaaaaaaaaaaagttatatgtgcagatttaaggcttaatttaaaaattggtttgcgtgcatactaagaagctcatttgctttaagtgagcatttcctttttgggcttttgttgggcactgtgtgtctcccatgttccccatttgtctgccacccaataagcatggtgtcgagggctgaagtagaaatcagaggctagaatctgaaagcttcattagggttctgctttttgcagattagggactttggcccttagtgagctgaggatcttggtttcctcccagtgtgcggtttcagggatgtcggccacatgatgtgcctgttgtggaggagggctgggtcgccagtgtgacaggagacagcagatcccttttgtgaaaggagaactggtactttgcgtgatgttaaacttcacaaaccgctgctcagaaatctgctattttccttctcttttaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414930 - DNA, 2967 bp, Homo sapiens
cgtacaggactaagcaatctcatcctgttctcagcaaacacctgtcgctgtacaacaatggttatcaccttcttggcttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414931 - DNA, 1122 bp, Homo sapiens
  misc_feature (280)..(280): n is a, c, g, or t
cattccactcagtattatctttgtctactctataacatccccgcatccagtgcgcacttctggcaggatgtgagggtgcagcccaaggctcctactgaagtggcgcataactgacgctgtgtgtgtcatgactcgaagaacccgctgcacttacaggtagaggtggtcactttgtttacggagtttggaagagacccatactgctacttgtgttttggacttaactgaacttggacatggtctgagttagaaccacttgttttggagaagtgcgcctggntgcgcacccaggcgcacttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414932 - DNA, 956 bp, Homo sapiens
  misc_feature (114)..(114): n is a, c, g, or t
tggggttttggtgtggatgtcctttctgtttgttagttttcttctaacagtcaggacccttagctgccagtctgttggagtttgctggaggtccactgcagaagtgcgcctggntgcgcacccaggcgcacttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414933 - DNA, 681 bp, Homo sapiens
cagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcagactttatggacagcagcctgcgacctatgaggtaccggctgactga

SEQ ID NO: 414934 - DNA, 337 bp, Homo sapiens
cgatgagacatccgtggtttcctcacctccaccatacacggcctatgctgcaccggcccctgaggtagggagaaccctgagcctccaggtgagggaagtttggggtctctgctgctgtcctgctttgttttgtttttttaaatgaaattagaaatgtactctaaaccttttcttcttaaaacagatgatttcttatcaacgtttgttttcatgaaatgaagcaactattttatatagttcagcacattataatgtgctgtattaatgtgtaacacgtttttaagatagatctaaaaatgcatcatgttaatgatagttgccttgggtaatgagattt

SEQ ID NO: 414935 - DNA, 447 bp, Homo sapiens
ggactcggcctccaggcatcccatccttgggggaatgttgccaagcacggggcttggggcagctgctccactataatcatgaaaggcttttgcttcacttgaatgttcacaagtatctctccttttaggagctgcacagtaaaggtcccaaaatacacaccaccacgagtgcaaaaacccaggcggttctcccaacgcgatgtttttttcccagcgaatctccgataagaaggtctgtgcagatttctgtgctcctacctgcagtaaatattcgtagacgtataaagctaacttttccccagcctgcccgtccgagggcaccaaggagcctttgcctttggcaaacatggtttgcagggaagagggcgcccagcctccccacagccgccaccgctccggctctcccgagctgcccctcgcccccggccccctcccaggcgctccctc

SEQ ID NO: 414936 - DNA, 624 bp, Homo sapiens
  misc_feature (26)..(26): n is a, c, g, or t
gtacatatacaatcgagccggtaccncataggtcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcagactttatggacagcagcctgcgacctatgaggtaccggctgactga

SEQ ID NO: 414937 - DNA, 3679 bp, Homo sapiens
cagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacaatcagatagcctggacttggctgtcatgagtgcttgatcctggtatggaatgctactgggtattacgtgccggtattttattccttggcgcactcccttgatgcaatgtttgtagctcggcgctcagatgtctttggtcagggccctggggggccgaggtcggtcgaactttccggtgggacgttttccccgacgtaaccccccggagggggcttttagggggggccccccggcgccggcggcacacgccgcggtgtttcccc

SEQ ID NO: 414938 - DNA, 3801 bp, Homo sapiens
cagaacggcggccaggacgccggacgtgcggcagttgcaggcgagcaggcgaggaatcgccgtggcgtcttggtgttctccacgctggttcgcaggtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414939 - DNA, 3655 bp, Homo sapiens
tatgattttgaacctgcctgtttttgttctgtaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaattcctggagaagccagaacaatatacaaacaagtatgtggaggcagatttgctttattccaagaggctgtttgagtgtgtgtctgcctaagcctccttatagcctatttttctacttgcctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagca

SEQ ID NO: 414940 - DNA, 2127 bp, Homo sapiens
aatgcatgaaggaaactccgtttacacatgctcgtaggatcccctgcgtggaaacagcagcttgtctctgactacccggaggacatggagcaccccaaataggaactttagagggattgaaatctgttgcctgttccactaggaatattgtttgcaaggcacaaggtgtcttttggtagtgagcgcgctctgcgcatgcgcaggtccattcgggaattactgcccagcagccgactaagttgcattccttgaatcttcgcagaaaagacaattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccactggatgagcagaactgcaccctggagatcgaaagttatggctataccactgatgacattgaattttactggaatggaggagaaggggcagtcactggtgttaataaaatcgaacttcctcaattttcaattgttgactacaagatggtgtctaagaaggtggagttcacaacaggagcgtatccacgactgtcactaagttttcgtctaaagagaaacattggttacttcattttgcaaacctacatgccttctacactgattacaattctgtcctgggtgtctttttggatcaactatgatgcatctgcagccagagtcgcactaggaatcacgacagtgcttacaatgacaaccatcagcacccacctcagggagaccctgccaaagatcccttatgtcaaagcgattgatatttatctgatgggttgctttgtgtttgtgttcctggctctgctggagtatgcctttgtaaattacatcttctttgggaaaggccctcagaaaaagggagctagcaaacaagaccagagtgccaatgagaagaataaactggagatgaataaagtccaggtcgacgcccacggtaacattctcctcagcaccctggaaatccggaatgagacgagtggctcggaagtgctcacgagcgtgagcgaccccaaggccaccatgtactcctatgacagcgccagcatccagtaccgcaagcccctgagcagccgcgaggcctacgggcgcgccctggaccggcacggggtacccagcaaggggcgcatccgcaggcgtgcctcccagctcaaagtcaagatccccgacttgactgatgtgaattccatagacaagtggtcccgaatgtttttccccatcaccttttctctttttaatgtcgtctattggctttactatgtacactgaggtctgttctaatggttccatttagactactttcctcttctattgttttttaaccttacaggtccccaacagcgatactgctgtttctcgaggtaagagattcagccatccaattggttttaggtcttgcatatcagttttattactgcaccatgtttacttcaaaaagacaaaacaaaaaaaaaattatttttccagtctaccgtggtccaggttatcagctctttaagagctctattaattgccatgtttacaaacaaacacaaagagagaagttagacaggtagatctttagcagtcttttctagtttccctggatttcactgatttattttttagggaaaatgaaaagaggaccttgctgtccgcctgcactgcttcctggtaaactataacaaacttatgctgcc

SEQ ID NO: 414941 - DNA, 557 bp, Homo sapiens
catgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccggtaaatggctttatgttgcatgttttaatgttgttgttgttttgtttcattttaaacttttggaagtgggcaaaggggagagaagcaagaatatatagatgaatatataaatggggtgtcatatacttatgaaggtctattacaaaccctcatgtagttaagggctttttacaaattataggcaacacatcaaaattaactaccagttttaacaaggaaatatctgaactgtaacctgttattataggatatgtaaagtggtggctctttattctttggtgtcacctttagtcattcttttgagaaacagatgaaacctatatattcataaactcatatatgcctcaaat

SEQ ID NO: 414942 - DNA, 367 bp, Homo sapiens
ctcatgtgagctgtgcctctgtcaatcattacggcagatgagaagaggtgtgagggagtgtgtcctgtttgtgaatgttgtctgtcatgtgtgccagtcaagttaacagctgctctaaaacacacacacatgcttctcctcagtggtgttggcacggggtttggggtggggtgagcctctcagcaagggtggtctgtctctggaggcttcctgggccccatagtggtttcctccccatcccttggttctggcccgtcccccttctcctctggctgaaggtaaccgcgggggtgaaggatgtgggcaggaaaggaccagagggctaggggcttgcatctcagaagtcagaagcaagtcctgtgtgctt

SEQ ID NO: 414943 - DNA, 1514 bp, Homo sapiens
gatctggtaaacctgaagcaaatatagaaacctatagggcctgacttcctacataaagtaaggagggtaaaaatggaggctagaataagggttaaaattttgcttctagaacagagaaaatgatttttttcatatatatatgaatatatattatatatacacatatatacatatattcactatagtgtgtatacataaatatataatatatatattgttagtgtagtgtgtgtctgattatttacatgcatatagtatatacacttatgactttagtacccagacgtttttcatttgattaagcattcatttgtattgacacagctgaagtttactggagtttagctgaagtctaatgcaaaattaatagattgttgtcatcctcttaaggtcatagggagaacacacaaatgaaaacagtaaaagaaactgaaagtacagagaaatgttcagaaaatgaaaaccatgtgtttcctattaaaagccatgcatacaagcaatgtcttcagaaaacctagggtccaaggttaagccatatcccagctcagtaaagccaggagcatcctcatttcccaatggccctcctgttccctctactggcagccctagtgatgaccagctatagccctgttggatctctgggctgtgatctgcctcagaaccatggcctacttagcaggaacaccttggtgcttctgcaccaaatgaggagaatctcccctttcttgtgtctcaaggacagaagagacttcaggttcccccaggagatggtaaaagggagccagttgcagaaggcccatgtcatgtctgtcctccatgagatgctgcagcagatcttcagcctcttccacacagagcgctcctctgctgcctggaacatgaccctcctagaccaactccacactggacttcatcagcaactgcaacacctggagacctgcttgctgcaggtagtgggagaaggagaatctgctggggcaattagcagccctgcactgaccttgaggaggtacttccagggaatccgtgtctacctgaaagagaagaaatacagcgactgtgcctgggaagttgtcagaatggaaatcatgaaatccttgttcttatcaacaaacatgcaagaaagactgagaagtaaagatagagacctgggctcatcttgaaatgattctcattgattaatttgccatataacacttgcacatgtgactctggtcaattcaaaagactcttatttcggctttaatcacagaattgactgaattagttctgcaaatactttgtcggtatattaagccagtatatgttaaaaagacttaggttcaggggcatcagtccctaagatgttatttatttttactcatttatttattcttacattttatcatatttatactatttatattcttatataacaaatgtttgcctttacattgtattaagataacaaaacatgttcagctttccatttggttaaatattgtattttgttatttattaaattattttcaaac

SEQ ID NO: 414944 - DNA, 247 bp, Homo sapiens
cgcccagccaaaaattggtgttcatacaaaaacttatgtgcaaatattcacagcagctttatctgtaatagctccaaactggaaacaaccaagatgtctttcaataggtgaacagagggaagtgggtgggcaacatgaaggatcattgtggtgacagatatatttggagccttgactatatcagtgtcaatatgatggttatgatatggttctatagttttgtaagaagttacctcgagaaactgag

SEQ ID NO: 414945 - DNA, 974 bp, Homo sapiens
aacttctgagaagggcttagaacaaattttttcccggagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtgtgattataagctttactgtctgcgaccatctctcagaagtttggagaggaaagccatcagagccatagaagatgagaagcgagagcttgccaaactgagaagaacaacaaatagaattctggcttcctcctgctgtagcagtaacattttaggatcggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccgtgcagcccgtgcaacccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgcaaa

SEQ ID NO: 414946 - DNA, 753 bp, Homo sapiens
aacttctgagaagggcttagaacaaattttttcccggagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtgtgattataagctttactgtctgcgaccatctctcagaagtttggagaggaaagccatcagagccatagaagatgagaagcgagagcttgccaaactgagaagaacaacaaatagaattctggcttcctcctgctgtagcagtaacattttaggatcggtgaatgtatgcggttttgaacccgatcaagtcaaagttcgagtgaaggatggaaaggacttgcctgaaactttcccgaaacttctttcttgtgatggaagaaacatggaaggacaaaggtcatccacttgaaaaggttttccacgggtaaccatgaccaagaactagctctatgccaggccgaaactgtcagtgtggcatgctttctcttttctcatccttacagtagccctcagaggttgatgctattattatccctggaacaggatcagtgagatagtcatt

SEQ ID NO: 414947 - DNA, 786 bp, Homo sapiens
aacttctgagaagggcttagaacaaattttttcccggagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtgtgattataagctttactgtctgcgaccatctctcagaagtttggagaggaaagccatcagagccatagaagatgagaagcgagagcttgccaaactgagaagaacaacaaatagaattctggcttcctcctgctgtagcagtaacattttaggatcggtgaatgtatgcggttttgaacccgatcaagtcaaagttcgagtgaaggatggaaagcccgtgcagcccgtgcaacccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgcaaa

SEQ ID NO: 414948 - DNA, 423 bp, Homo sapiens
tggaactgaaacaagacctgcatgaccctgcagtgtagagtatgaaaggactgataaacatttggattgtacacttaaaacgggtgaatggggtggggtgcgaattatagctcactaaaactgcttcagaagacaagatgaggaggcagcactagggccagatggcagaggagcttataagtcatccctcagaggcggaacttcatcctgatgatggcagcaggaagcctttgtagggactggtgtgaagggatttgctgctgggcaaggaatggaatggaggggcagaagtgggtatggagagcactggagtgagagtgagatggtaatgcggtcagaggagaaggcgcagcattgaagtcatgtccatgattagctcctgctttctcacactcactgtgttgctttgcagaagacagtttc

SEQ ID NO: 414949 - DNA, 366 bp, Homo sapiens
ccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttgtgagttctggcagagaggagggactgctctctctcagcattttatcttgggaatatagttataatcctggactctgctgcttggtgggagtgataaataattatttgacatggaaatttaatgcaaagtctccagggtagaatgtcctgtcttccagcagtttcttactgctttcttaa

SEQ ID NO: 414950 - DNA, 3270 bp, Homo sapiens
ggataccataggcagcttctaaaggctgcttacctagattcttctcaaaattgtgtccaagatgttaagtaacctgctattcctgtttagtggttacataacatgtacttagtgtctttgtggagctttgggctggtaggggcagggataggggaaagctaaacagaagtagaagaaaaggtccttgtccagaggaaggttattttaagagacaggacatgtaatttataacaaatggacatttgcaatatagcaacagtctgagtctagaagtgttcaaccatcacatcgcttctcctgacttttctgttgtcctatggctatgagactacaggggttgggggatggggatgcccccaccaccaccagtgtgagaatgagatatggttggggaggcgtgtttggcacttttacaaggttgcattgtccacatttgcttggatggtggcatctgtagcccaaatgggcattcagtcttttcttctgctgtgaggtaagagtaattcagacctaatgaatgagaagagggagcactttgatccacagactttggattaacactgtacccactcttagcaaaaggggacttctctaacaagctagcattgtgttaacctgtcattaacccagcattagagacaggtcactgggatgttcattctggctctcagcctgctgttatttccccactctcacctgtgctagttcgctttctccagaagaggagctgaggtggtcttatcctcagataggacatgagaaattggaatttggcaagcaagggcttcagcatcctttagtttctaaagcaagatcccttcagagaagtctagcaggaagaagccaggagaatgtagaatggaaaagagctcttactccaaattttagagaagtttcagctctacttctcatcttttctctcctggtcttacttgaatgcatgttggtaatctgtatacattactatgactgtgtctatcacaagtcctacaaaataaaaatggacttaaaagtactctctgctgaggctgtaagttttgttttgtgagaaataggtaaagacattagcatttaatctactggaataagctggttgctgtggcttatacctgtagtcccagatacttgggaggctgaggcaggagaatcacttgagaccagcctgggcaatatagtgagacctcacctctaaaaaagttttttataaatttacttgtctaaagtggggaaagggaaattattctgttttcttattcttgcttcaagactatgacagatttgaaagagaattctaaagcagatttagagaacctgcttctcttcttatctcctaatccctaaattgtaatttagctcttatctgtattgttgtgttgtttggtaaagggatgatttttacattgagttttaaagtagaataagaaaagcttctaaaaacttgcattgtgctagggatctgccctatatctttgcctctggtgtttcgttgttgttgttattgtttgtttgtttccaaagaagttggagttaaggacacaatatatttgtacccctagactgaatgggtgagtattccatatgaggatctgggtaatcctctttgcaacccacatttggtcttcagagacactggcattttgaagaaacatatgatatagctgtttggaaataaattcatctatgttactttttttttctttttttttttttttatgagcaggagatcttaattgacagaaactcattggtggttggagtggccaatgggcacgggaaaaagtatccagtaatcagaagaattgtatctgggttatgtaatcttatgcacattccattgtctttgccaagcccagaagccatgttgtgttcattgttaagaaatttgatagatttacccagcttttctatgtattttgacttattgaaaatatgtaacaactgagtcgggttgcagcactggtggggtagaatcgactttccctgaaggtgacacagatgtcagaattgtgtccagggatttaatttagacccatactgtccaggagactgtctctagttggatctctgtgctgactgactgacagacagactttagtgtctgtgtgctgactgacagactctagtagtgtctatatgttgaccaactggtagaccaggaggatctgtgtgctgattgactctagtaggatctgtttgtcactgacagactgtagtagtgtctgtgtgctgactgatagatagactatagtaaaatttgggtgttgcctgactaacggtctagggtctgtaagctgacagtctgcctgctttctgattgtatccattgaagtgtatgtacattatggtaattctctgtctattaaatgtgtctaacaaaggaaggaattaagcactccacatgttttctttataggggagttctgtacactatgattttaaatagatatttcttatatagtagtggccaaattctcattattttgtacaagataaaggttatgcatcacttttatggtattttgtgaactcagctaagggaatgcctgttcagagcctggagttgttacctttacttgaagtcatctcatccagtcccctgctttagggcaggacttcagttccactgttcatttctgaagcttctgtgtccccagcttaccctgttctgaaatgttgtattccattggacagggctgctatttttagtcagccatgcatttggattttacacttaatctagtaagtaaaaatgagaagaaaatttggcatttaaaaattgattttaagggttggcaaaagtattttttccagtaagcctttcactggatatctgtgaccaatgtttacctacgcaatgtttttgtatctgaattgcttatgtacgttttttattatattgacctaacaagaagatcaacttatgctggtatggtgatggttttgctatggcaaaatcaaagggctgatcatacatggtgccctttgggaagggggatggtgtggggctgagcacctctgggttgaatgggaatgggtcagattgggaagcctaggaagagagttctactgtagatttcctaggcactgctctgttgaaataggaacataagtctttagcaacattctgatttaatcgggtgacactgataacaaagtatgccactcagatccatttaaagtgtgcataactgtatttgaaatgtgtttttgtgtgcgtgtgtgtagaatgggtaaataaaattgttgagtaacttgaacctaaaaaaaaac

SEQ ID NO: 414951 - DNA, 2813 bp, Homo sapiens
ggctcaagggccagtgtcatgctgacactcctggcagcatcaggacagtggttgaatattcccagcctgccacgctgcctactaggagggtggtatcttaggagcagcagttgtttctggatgagctaccatacttgagatgccctctccataccatcttcaaacttactcctgtggcctatgggtgcaaagtggaaacaattaaacttaacgtggaggctgtgaacacgcaccgtgacaagccaactttcgctttctccagaagaggagctgaggtggtcttatcctcagataggacatgagaaattggaatttggcaagcaagggcttcagcatcctttagtttctaaagcaagatcccttcagagaagtctagcaggaagaagccaggagaatgtagaatggaaaagagctcttactccaaattttagagaagtttcagctctacttctcatcttttctctcctggtcttacttgaatgcatgttggtaatctgtatacattactatgactgtgtctatcacaagtcctacaaaataaaaatggacttaaaagtactctctgctgaggctgtaagttttgttttgtgagaaataggtaaagacattagcatttaatctactggaataagctggttgctgtggcttatacctgtagtcccagatacttgggaggctgaggcaggagaatcacttgagaccagcctgggcaatatagtgagacctcacctctaaaaaagttttttataaatttacttgtctaaagtggggaaagggaaattattctgttttcttattcttgcttcaagactatgacagatttgaaagagaattctaaagcagatttagagaacctgcttctcttcttatctcctaatccctaaattgtaatttagctcttatctgtattgttgtgttgtttggtaaagggatgatttttacattgagttttaaagtagaataagaaaagcttctaaaaacttgcattgtgctagggatctgccctatatctttgcctctggtgtttcgttgttgttgttattgtttgtttgtttccaaagaagttggagttaaggacacaatatatttgtacccctagactgaatgggtgagtattccatatgaggatctgggtaatcctctttgcaacccacatttggtcttcagagacactggcattttgaagaaacatatgatatagctgtttggaaataaattcatctatgttactttttttttctttttttttttttttatgagcaggagatcttaattgacagaaactcattggtggttggagtggccaatgggcacgggaaaaagtatccagtaatcagaagaattgtatctgggttatgtaatcttatgcacattccattgtctttgccaagcccagaagccatgttgtgttcattgttaagaaatttgatagatttacccagcttttctatgtattttgacttattgaaaatatgtaacaactgagtcgggttgcagcactggtggggtagaatcgactttccctgaaggtgacacagatgtcagaattgtgtccagggatttaatttagacccatactgtccaggagactgtctctagttggatctctgtgctgactgactgacagacagactttagtgtctgtgtgctgactgacagactctagtagtgtctatatgttgaccaactggtagaccaggaggatctgtgtgctgattgactctagtaggatctgtttgtcactgacagactgtagtagtgtctgtgtgctgactgatagatagactatagtaaaatttgggtgttgcctgactaacggtctagggtctgtaagctgacagtctgcctgctttctgattgtatccattgaagtgtatgtacattatggtaattctctgtctattaaatgtgtctaacaaaggaaggaattaagcactccacatgttttctttataggggagttctgtacactatgattttaaatagatatttcttatatagtagtggccaaattctcattattttgtacaagataaaggttatgcatcacttttatggtattttgtgaactcagctaagggaatgcctgttcagagcctggagttgttacctttacttgaagtcatctcatccagtcccctgctttagggcaggacttcagttccactgttcatttctgaagcttctgtgtccccagcttaccctgttctgaaatgttgtattccattggacagggctgctatttttagtcagccatgcatttggattttacacttaatctagtaagtaaaaatgagaagaaaatttggcatttaaaaattgattttaagggttggcaaaagtattttttccagtaagcctttcactggatatctgtgaccaatgtttacctacgcaatgtttttgtatctgaattgcttatgtacgttttttattatattgacctaacaagaagatcaacttatgctggtatggtgatggttttgctatggcaaaatcaaagggctgatcatacatggtgccctttgggaagggggatggtgtggggctgagcacctctgggttgaatgggaatgggtcagattgggaagcctaggaagagagttctactgtagatttcctaggcactgctctgttgaaataggaacataagtctttagcaacattctgatttaatcgggtgacactgataacaaagtatgccactcagatccatttaaagtgtgcataactgtatttgaaatgtgtttttgtgtgcgtgtgtgtagaatgggtaaataaaattgttgagtaacttgaacctaaaaaaaaac

SEQ ID NO: 414952 - DNA, 3266 bp, Homo sapiens
  misc_feature (3213)..(3213): n is a, c, g, or t
ggataccataggcagcttctaaaggctgcttacctagattcttctcaaaattgtgtccaagatgttaagtaacctgctattcctgtttagtggttacataacatgtacttagtgtctttgtggagctttgggctggtaggggcagggataggggaaagctaaacagaagtagaagaaaaggtccttgtccagaggaaggttattttaagagacaggacatgtaatttataacaaatggacatttgcaatatagcaacagtctgagtctagaagtgttcaaccatcacatcgcttctcctgacttttctgttgtcctatggctatgagactacaggggttgggggatggggatgcccccaccaccaccagtgtgagaatgagatatggttggggaggcgtgtttggcacttttacaaggttgcattgtccacatttgcttggatggtggcatctgtagcccaaatgggcattcagtcttttcttctgctgtgaggtaagagtaattcagacctaatgaatgagaagagggagcactttgatccacagactttggattaacactgtacccactcttagcaaaaggggacttctctaacaagctagcattgtgttaacctgtcattaacccagcattagagacaggtcactgggatgttcattctggctctcagcctgctgttatttccccactctcacctgtgctagttcgctttctccagaagaggagctgaggtggtcttatcctcagataggacatgagaaattggaatttggcaagcaagggcttcagcatcctttagtttctaaagcaagatcccttcagagaagtctagcaggaagaagccaggagaatgtagaatggaaaagagctcttactccaaattttagagaagtttcagctctacttctcatcttttctctcctggtcttacttgaatgcatgttggtaatctgtatacattactatgactgtgtctatcacaagtcctacaaaataaaaatggacttaaaagtactctctgctgaggctgtaagttttgttttgtgagaaataggtaaagacattagcatttaatctactggaataagctggttgctgtggcttatacctgtagtcccagatacttgggaggctgaggcaggagaatcacttgagaccagcctgggcaatatagtgagacctcacctctaaaaaagttttttataaatttacttgtctaaagtggggaaagggaaattattctgttttcttattcttgcttcaagactatgacagatttgaaagagaattctaaagcagatttagagaacctgcttctcttcttatctcctaatccctaaattgtaatttagctcttatctgtattgttgtgttgtttggtaaagggatgatttttacattgagttttaaagtagaataagaaaagcttctaaaaacttgcattgtgctagggatctgccctatatctttgcctctggtgtttcgttgttgttgttattgtttgtttgtttccaaagaagttggagttaaggacacaatatatttgtacccctagactgaatgggtgagtattccatatgaggatctgggtaatcctctttgcaacccacatttggtcttcagagacactggcattttgaagaaacatatgatatagctgtttggaaataaattcatctatgttactttttttttctttttttttttttttatgagcaggagatcttaattgacagaaactcattggtggttggagtggccaatgggcacgggaaaaagtatccagtaatcagaagaattgtatctgggttatgtaatcttatgcacattccattgtctttgccaagcccagaagccatgttgtgttcattgttaagaaatttgatagatttacccagcttttctatgtattttgacttattgaaaatatgtaacaactgagtcgggttgcagcactggtggggtagaatcgactttccctgaaggtgacacagatgtcagaattgtgtccagggatttaatttagacccatactgtccaggagactgtctctagttggatctctgtgctgactgactgacagacagactttagtgtctgtgtgctgactgacagactctagtagtgtctatatgttgaccaactggtagaccaggaggatctgtgtgctgattgactctagtaggatctgtttgtcactgacagactgtagtagtgtctgtgtgctgactgatagatagactatagtaaaatttgggtgttgcctgactaacggtctagggtctgtaagctgacagtctgcctgctttctgattgtatccattgaagtgtatgtacattatggtaattctctgtctattaaatgtgtctaacaaaggaaggaattaagcactccacatgttttctttataggggagttctgtacactatgattttaaatagatatttcttatatagtagtggccaaattctcattattttgtacaagataaaggttatgcatcacttttatggtattttgtgaactcagctaagggaatgcctgttcagagcctggagttgttacctttacttgaagtcatctcatccagtcccctgctttagggcaggacttcagttccactgttcatttctgaagcttctgtgtccccagcttaccctgttctgaaatgttgtattccattggacagggctgctatttttagtcagccatgcatttggattttacacttaatctagtaagtaaaaatgagaagaaaatttggcatttaaaaattgattttaagggttggcaaaagtattttttccagtaagcctttcactggatatctgtgaccaatgtttacctacgcaatgtttttgtatctgaattgcttatgtacgttttttattatattgacctaacaagaagatcaacttatgctggtatggtgatggttttgctatggcaaaatcaaagggctgatcatacatggtgccctttgggaagggggatggtgtggggctgagcacctctgggttgaatgggaatgggtcagattgggaagcctaggaagagagttctactgtagatttcctaggcactgctctgttgaaataggaacataagtctttagcaccctcctctttttcccgccgcccccctattccccctctcccccccccctcccccctccgctcccccccccccctcacctctccctctccccccnctctccctgtgtgtagaatgggtaaataaaattgttgagtaacttgaaaaaac

SEQ ID NO: 414953 - DNA, 1188 bp, Homo sapiens
ccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggttggtgacacccctacatatcatctcctcttcaccttttgtgctgtgtgtgttgtggggtgtgtgtgtgtgtgtgtgtgtgtgtgttgttggggaggggtgttttcgtaatgaaagagagaaatagacatgtttaacatcacaaagagatcttttctatctgccagagccccatctggtacttctacactcttctcttgggagaggaaactgaggctttaaggaatcaagtaagaattagctgttgaattgaaaccagggtttaggttgtaggattcttggccctgtgctctaggtattatctggatgttgagacctagatgttggaatagatcagccgggcacggtggctcatgcttgtaggctcagcactttgggaggccgaggcaagtggattgcttgaacccagaaggatcaccttagcctgggaggttgaggccacagtgagccgtgattgtgccactgcagtccagtcttggtgacagagtgagaacatgtccagggaggttgaggctgcagtgagccatgattgtgccactgcagtccagtcttggtaacagagtgagaacatgtctcaaaa

SEQ ID NO: 414954 - DNA, 435 bp, Homo sapiens
tggtgtgacagggcttggtttcatctcagtaaatatcttaaggggaagttaaatggaagttatctgatgggcaagtgaccttgggcttgggtggtcagaagaacagggctcagggtgattgatacctgtgtgcttgtaggagaagtctaaagagggctaagatctgtgcattggggcaggggcaggaaggggttataggatggtgtgaaaaccctcagtgagaaagttgaaagatctagttagagaaaggttttgaacagtgggaaactaagtgggcagggatgtgacttctgtagccacccgaatgtttgtgtctctgactgtttgagcttagctctccttgctggtttcatttgctcttatggcagacagtgtgctctggtggcgctggaagatgttaaggcgtatctcactgaggagaatggtcagattgcg

SEQ ID NO: 414955 - DNA, 575 bp, Homo sapiens
gtcacaggacggggcggggcggggcggggggtactcaatgagtggagtgccaatgttccagtgaaaggcgacatttatggacttctttttcttttttttagcagtggctatttgtaggaggactgttacgggcagacctctgatgaggcctttactggttcctatgatttcaggaggttaaggtatcaagccctgactatcctgaaaggaacagagagaacgtgatggaggacttcctgaagagaattgaatgctacaaagttacctaccgacctcttgacccagacaactatgacaagtaaggtttaaggccatggtttgaagggcccaaggcaaaggtctcatctgggaaaataacctttctccctgagttctctaacttccttctgataatctagatctacagtgttaacatcatcccagagaaataaggtatggatttgtggcttttatgtggattgcatcttgtacatgaaaaattgaagtggttggttttgttttgttttgagacagggtctcactctgtcacccaggctggagtgcagtggcaaaatcagggcccactgcaactgctg

SEQ ID NO: 414956 - DNA, 3523 bp, Homo sapiens
  misc_feature (2318)..(2318): n is a, c, g, or t
ccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactgcagcagagaccacactggctgtgcgcagacgcccctccgcagcgtccctcatgttgccttgctaatgatgtggatgttcaggcctcacctctccaaacgactgggatctactgaaaagcttgggatgtcagcttcacagaggctagaacaggaagttaagtgggaactggactttgggggccaccaaaacgaggcctggagaaacgtcaccatatttcctcccctcctgcctaatgggaatatcagttacactgaaaaatttaacttccctgtgcctcaaaacatttagcaacctgaaccagtgactttttgtcatctctgtgctgagtttggtccaagttggtcaatctcattctgtataggcatttaacatcctacctgtgactgtctgcatcctttgctggctcttttttgcccaaagtgcaaatgcacttcttcagatttacttttcaagtgagaaggtaagagctggtctctgccactgttccaggcgagcaggctagagtctaatatacttatgctagcagttaccatttgccacattggaagcaagagacaaatcaccaggtgaatggagggtcttctgagaaattcagtccctaaaacatcttctctgccttgatagaagaacagtgtcagtggcaaccttttcatttagagaagtttttcttgttccaggcccttcaggacaggatctgactgcaagactccccaaaatgggtacccatcttttaagttcccttttgtagctactgtacttttgacttgatgcatgtgcctctcatgcatcaagatggggctgatgtggttctcctgggtggttgggaatgtggactagacagaaaagtagagtgccatttatatcncgtgagtaagtcaagaaagctccttgagaatcagcccgatcagggagtgttttggcttcagaacaggtggaaggagacacgcccctctgtgggctctgtcaccatgatacagtccttgagagagctgtggctgtgacttggagggcagtagtctcctgatacctgcctcttggccactggtcactattgtggtcactgatctctcatataaaagtgagggtggcggggtcatggaccagcgcctcagtgcattagtcattcgcttttccttacagacaaatcagataactcttccccagtgattgtcaaatgtatgaatgtatctctgtaaatgtggttttgacatgtcactgttactgaaggagagtatggaatccccacaggatattatatcttgcaaggaaagtctatttttttaaagaatagtatgtttttagctttacttttctttcttttccttttcactcaaatgctcacttgctgggcaaaagggtgagtagcaagaaaagtaatgatatgtagcttttctcaaatggttcttttatactgtggatgatacaggactctgttacctaagatgtgataagctgggctgcaggcggttcagcatccagcaactaggagctgcttttctacgtacaaagctgccttcaggaaggctccttaccctgtagcagatgattttcatctggctgcctaccgcatgctgtactataatgatttagttgtgatatggatttctctctgcatcgaaaactgtcttttgatgatcagacaatgtttatatttagttatttattctatccatgtaaggcatttttgagttttcttgtcactgtttgcatgtatttaatcagaatgtaatataatttatgttgtcaggtttttttttgtttgtttgtttggggttttttttgtagaaatttaggtagttagagcttttaagtctaatgtcatattaacttaagttaaatttccagaacgtagatatctgtcttctgtaaaaggaaaataacgatgttaagggacagtgaattttttttgaatactttgtttctcattgatttttattgtaagtgtaaaccaagagatgcatttctctggagaagtgtttatctcctggattaataaaatcatgctaaaatatgcgagtaatatgtattgcttttgtaataagaacataaaataaaattatttttaattaa

SEQ ID NO: 414957 - DNA, 2157 bp, Homo sapiens
ccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactaacaacttccccaagaaccaaacccctgtaaggatgagaaggaacagctttacgcctctgtccagttcgaatacaataaggcgtccaagaaattacagtgttgggagccggcccctcaagcccctcagccctctccgtgcccaggacatgcaagaaggggccgactagccgaagacccaagtcagcattccggtggtgtaactgtgtgtttccctccagccctggcctcctgcccttgtcactaatcaccaaggagtcattaacttcctccctctatgcccacccctgacacttcaccatttatcttaacacagaacatgaggttatgtgtagcaaattgagtcttttaggacagattctcagatgggatgatctggaggaggaggaaaaagatacacgcccttggggctgagcatgccccacactcttggatcttctctctgttccctggtgtcttcactaatgtcctcatgttggtgaagtgttgggggatggagggcgggtgagcagtcgggggacaaaaagtctatttttccttcacttttgtctcttcaatgtgtgttttcctcacactccttacttgactgctttcttcccccactttcatgtcccctctggattgtccagtgtaatgcatggcattgtggtgtctgtctaggaaggaaggggtgattgacaagagacaagtctggcccagttaatgctg

SEQ ID NO: 414958 - DNA, 2216 bp, Homo sapiens
ccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactaacaacttccccaagaaccaaacccctgtaaggatgagaaggaacagctttacgcctctgtccagttcgaatacaataaggcgtccaagaaattacagtgttgggagccggcccctcaagcccctcagccctctccgtgcccaggacatgcaagaaggggccgactagccgaagacccaagtcagcattccggtggtgtaactgtgtgtttccctccagccctggcctcctgcccttgtcactaatcaccaaggagtcattaacttcctccctctatgcccacccctgacacttcaccatttatcttaacacagaacatgaggttatgtgtttataggacaacttaagctgttcttcagtttgaaacatcttttcacccaggggcaaggtagcaaattgagtcttttaggacagattctcagatgggatgatctggaggaggaggaaaaagatacacgcccttggggctgagcatgccccacactcttggatcttctctctgttccctggtgtcttcactaatgtcctcatgttggtgaagtgttgggggatggagggcgggtgagcagtcgggggacaaaaagtctatttttccttcacttttgtctcttcaatgtgtgttttcctcacactccttacttgactgctttcttcccccactttcatgtcccctctggattgtccagtgtaatgcatggcattgtggtgtctgtctaggaaggaaggggtgattgacaagagacaagtctggcccagttaatgctg

SEQ ID NO: 414959 - DNA, 2774 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414960 - DNA, 1688 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttaggga

SEQ ID NO: 414961 - DNA, 737 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggtaagtatgccattattttgccattggagattatgtaaactttgtggggtttttatatgacttgtatatttcaaatccattttaatagttagattttgaaaactagatccatgttttacttagcacaccatatgcagtatttttagaaattaaaataataataatgaaggagtcgcagaaggactctggtttttgtgggttttttggtttttttttttttaatcattctaatcccaaggaggattgttttttgattctaccgaatgtctttattgctaagttttaagaagaaagtgatatgaactc

SEQ ID NO: 414962 - DNA, 311 bp, Homo sapiens
atgccgggagtggttgtgtacggtccgcagcggcaggtgaagcctagcagaggacgcggccaggcgattcggtgaagcgattcctgcaggcgttggttcccctctttgacctggtaaatgcaggcttttatgcgagaggtaatggtgggggtaaacttgctgcaaacgaaggccaggggcgtcggtggcgcaaggtgaatcgaaagtgggaggatggaaggctgtggagattgggaattgggaagggggcagggactgcttcagtttctgtcgacgcggccgcgaatttagtagtagtagtaggcggccgc

SEQ ID NO: 414963 - DNA, 1767 bp, Homo sapiens
  misc_feature (1712)..(1712): n is a, c, g, or t
  misc_feature (1715)..(1715): n is a, c, g, or t
  misc_feature (1717)..(1717): n is a, c, g, or t
  misc_feature (1733)..(1733): n is a, c, g, or t
  misc_feature (1738)..(1739): n is a, c, g, or t
  misc_feature (1746)..(1746): n is a, c, g, or t
  misc_feature (1748)..(1748): n is a, c, g, or t
  misc_feature (1761)..(1761): n is a, c, g, or t
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggaaaacaaaaaaaaaaaaaaaaaacnttntnggcgccccggccccanaaaannttttaanancattgtggggcgngggccc

SEQ ID NO: 414964 - DNA, 2908 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagttttcattagcaacttcagcttttattttgttgggccttaagaggcagtacagactgtggcacctccagttatattatctaataggtgatcacatctcacagtccctggagacttgagagtcttagatacaaagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414965 - DNA, 2799 bp, Homo sapiens
atgccgggagtggttgtgtacggtccgcagcggcaggtgaagcctagcagaggacgcggccaggcgattcggtgaagcgattcctgcaggcgttggttcccctctttgacctggtaaatgcaggcttttatgcgagaggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414966 - DNA, 2610 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414967 - DNA, 2647 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacactgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414968 - DNA, 2700 bp, Homo sapiens
atgccgggagtggttgtgtacggtccgcagcggcaggtgaagcctagcagaggacgcggccaggcgattcggtgaagcgattcctgcaggcgttggttcccctctttgacctggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414969 - DNA, 2781 bp, Homo sapiens
gtggctgctcctgggtgtagtgagatgtctccagccagggccaagcagcagcagtagcagcagcagcagtagcagcagcagcagcaacagcagcagcagcagcaacagcagcagcaaagggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414970 - DNA, 2995 bp, Homo sapiens
gtggctgctcctgggtgtagtgagatgtctccagccagggccaagcagcagcagtagcagcagcagcagtagcagcagcagcagcaacagcagcagcagcagcaacagcagcagcaaagggaagcctggagccagaggacttttggtggctgaggccttagctacctggcttacacattaaggaggacacagatttgcttgctgtctgtctgtcaaggcctggctcagctaaggacctgttaacatttctagagaagaaaacagcattaccatgttggttgaatctgctgatgaggagcgactacatattttggattttaacctgttagcagatgatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414971 - DNA, 1629 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttaggga

SEQ ID NO: 414972 - DNA, 2532 bp, Homo sapiens
atgccgggagtggttgtgtacggtccgcagcggcaggtgaagcctagcagaggacgcggccaggcgattcggtgaagcgattcctgcaggcgttggttcccctctttgacctgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414973 - DNA, 2539 bp, Homo sapiens
gtggctgctcctgggtgtagtgagatgtctccagccagggccaagcagcagcagtagcagcagcagcagtagcagcagcagcagcaacagcagcagcagcagcaacagcagcagcaaaggttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414974 - DNA, 2422 bp, Homo sapiens
tacttaactggaaaacaacctgctgtatcaaatacatgtttaattttaattaaatacttttaaatggactttattttaggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414975 - DNA, 1010 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataagtcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcaggtatcttaaaaggcaataaagctaaatgttccttgctatatgatttaaagcaattaaaacacaaattttagaaattagtaaattaacacaaagtttctaatattgctgaaggataatg

SEQ ID NO: 414976 - DNA, 1825 bp, Homo sapiens
aggagctatgatagagaatgaggctaggaagaaaaccatattgtatatattgaattaaagtttgccgtgtttacattcaacaatatatggacaagtaagtgtgcactgacactgttttacctgataatatgagttttcatggggttgtgagagtttttttaatcctattgattgttgttacattttgcttcccagtactctgttctgcagctgaccaaaatgctaactgttctctgggacgagaacaggagagttgtcactctcctctcctattcaacctaaactatttctttcatctttcaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgacctgtgaggca

SEQ ID NO: 414977 - DNA, 1103 bp, Homo sapiens
atgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatggtaaaagctgttgatttctggtgtttgttggcatgtgatgattcttattttatataagaataaataaattcatatataaatcttattttatgtaatactgaaaatacttttcattattttgtaatgttttacttttttgtttttttcttttttaatcacagaagacatgtaaaactttataaacttagggtggtatatttgagtgtagcagacctttttcccccttatttgtcctcctagtgaaaaattgtcaattgatgtttgttccaacatggtcttttgtccttaaagaagtagagatttccagtggaaaaagaaaatagcatgtattgagcatgtactatgtgtctttttattgtgttctctcatttattctttacatcaacactgcacggtagggtttttccctttgttataggttagggaactatcatatcatgcattctttttatttttcctacatcattactatttgtttaaccctaacttacacagtttttcagtgcatgctcacatcttatatcattcttgtctccttttgctctttatcatatttgcttagttacctcaaaaagatattcttacttatttccctttactcttttctttgatatcctttatgcaatataggagacaaattatgggtgttaacttttgaaagcaattaatttcaatgctaagtagtctgtgtaaaatctgttctcatgtattatatacaataaatttcaatttttgaccaatgtacttt

SEQ ID NO: 414978 - DNA, 517 bp, Homo sapiens
tgctaaaaaatgctgacagacacaaaatggggacatggtgtttgaaaaatggtgcctatcgacttgttggacacagagttgctacaaaccttcagtttactttaaaaaaaaaatgcaccatctgcaaagcacagtaaaacaaagtgtgcctaaagtgtggtatgagagtgttgaatcagcctgtacttagacaaaatgaagccatcgaagattttgaaggtcttagggtttgagcattttttacttttaaaaacttgtatttattttaattctagaacagtaaattcttaagtaatctctttaagtcactacgtttataatatttatgccaatttttttaaaggatttgaatttgttgaaatgagcagtcgtaaatcaaagagtaacagcttaattcacacagagtgcctttcacaggttagtatgtattttcattaatctcaagatattttaccctgtaaagctgttcagagaaatagttatcttcttaacctgaattttccctttagcatttagg

SEQ ID NO: 414979 - DNA, 5526 bp, Homo sapiens
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttc

SEQ ID NO: 414980 - DNA, 1939 bp, Homo sapiens
  misc_feature (1084)..(1084): n is a, c, g, or t
tactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaaggtaaatttttaaaaaaccgagtattgtgttttagagtatgttacttgttttgcaggtatttggaactatattggtattagaactatctattcgtaagtcgcaaaagcagatctactagccaaattcagcaaatttagtgatttgtcataatcgttaagatattaacactatagttatacaagataaaatagtcaagcagcttgaagcaatttcaatatttcagacattactatagtcctgaaatgccagagtagatggatgtgtgatctcataattaagactgaacacacttcttggttttcttctttaataaaacatgtaatttcattccatctttaaagctttagaaatctagaggaaaaattcagtaggaatacgactgatgtaactgaagggcttatgttaagttttttggtcttaattgtgtttgtaggattattttagaaaattcaatagcatttataattgctataattgcattataactctttacagtacaagggttgatctctgtgtagatcaagctgtacgttgtaagagaagaatgtaaaatgcattgaagctgggtttatatgagccagaaatggacttctccctctgacaggcatttaaaaagattcaaagtgatagaatggctttaaaaagtctgtgtaatatttgccatactcttaaataacatcacattactctccaactcctctcttaacagttttgttttgagtaagcttcaagcttttagcttnttgggcagaaagatgatgtgatgtttaacttaacattttgaaagaagtagatttgattgtacttaaaaggaatataagttgtcagaaaacctcaaactttaaaaaacataaatgaagatatagattgacttccagttattcagagtaatttaacattgaaacatagggaagttgcatgaaaatgaaatatatcaattttgattcttcatagtaaggtttaccagatgaagtcttgtggttttcctcctactggcgatttctcgatctcctttccaggactttaaatgttggtgttcttcagagttttattccacatgctccactgatactatatgctgctcccatggcctcattttctatctgctgagtcccgtatcagttatctccagcccagatctctaacaggtttaactcatatttctagttgcatcctagacatctttatttgaatgtcctctaccacaaatgaaaatcaccatgttcaaatctgtacataatcatctttcctagcccccaaccaccagtttcatcccttagtgattgactccgcatttcacctagctacctaagctagaaacttggacatcattcatggctctttttacctcacttctcacatccaggtagtcaggaagttctctaaacaccgtgtcccaaatatctgcattatagcactttctagtacaagcgactgcaaaacaattgaaattaacttaatctggccaggggtagtcactcacacctgtaatctcagcactttgggagaccaaagtgggtagatcattagatgtcaggagttcaagaccaccccggccaacatcgtgaagccccatctctactaaaaatacaaaaaaa

SEQ ID NO: 414981 - DNA, 928 bp, Homo sapiens
tatttttatgctttcactgtttagatgctcttgtgggatattcattgttttataaaatagggtatattagtagttcatcagtgagaaactttaaaaaatgctgatttcttactttcacttccagagatttatctagattatagcctaagcattaaaacttttacagtttcttgaggtgattttaatggttagccatataaacttataaaataaatgtgtttcttaaatttcttttctaggcataaagatgtcatcatcaaccaaggtaaattaaaaatccttttgaaaaattttattttgcccttcttagtttaatttttgctaattgaaaagaatattttcatccagtgcactttatcagttcatagtaatcaaagaaaagtgcgttactgtagtcatttaggaaaaaacccagtttttattgtaaggtaatgtcatttttgtctcaaccagcaaaaatgtcaactcgcgaaaaaaacagccaaggtaagaataagctacgcagttggttgccttctaagtgaattttttcctggatctcttatttggctttttattatttatgctgcctgactttcttccttaaaaaggaaatacagtgatttgagctagatgaatccagctacattttacttttttttttgagaccgagtctcattctgttgcccagggtggaatgcagtggtgcaatctcggcttactgcaatctccacctcctggggtcaagtgattcttgtgcctcccaggtagctggggactataggcaccaccacacccggctaatttttggtgttttttgtttgtttgttttgtatttttagtagagacggggtttcaccatgttggccgggctggctgcaaactcctgacctcaggtgatcagcccgcctcagcctcccaaagtgcagggattacacgcatgagccat

SEQ ID NO: 414982 - DNA, 701 bp, Homo sapiens
cccggcttcgctgcgtttattgcaggtgggtgcacctggtgggagggcaggtccggggcgaggtcacacgacctcgtcggtcaccgggatggggttgacctggggacctcccgggggtccccccgccgccgccgcagcctcctcctcgctgggcttcttgcgggcctcggccgggggccgcggcggggggttgctgggcggctgcttgatggtgcctccgatctgcggccgcaaacgttttttttttttttttttttttttttccattttggggctattttggttttttattagttagattttggacaggacttgatttgaatgaagaacagtgtgagccactgagaaatttgtaaaggaaatgttaacagctaagagtttgaacatagataaaagctaaacagattctaaaataaaataaacatatatagcatcacagttatatttcttcagctaatttttctgcatccctgtgtttccatatcaaaggtgtctggccagaaggatctgatgggacagatatcaatgcactggtgcgatcccacaatagaaaggtgatagctgttgccgatgacttttgtaaagtccatctgtttcagtatccctgctccaaagcaaaggtaaactcactttaatagaaactaatgttataaggccttctgtccagggatgattttgcatccatagcaagaaaatatagg

SEQ ID NO: 414983 - DNA, 235 bp, Homo sapiens
gagagcagctgacttatgctctgggcagggctcagagctcttgtggcggtcgctcctcttcacgttgaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttc

SEQ ID NO: 414984 - DNA, 467 bp, Homo sapiens
atggctatgaaaaaatacaggtttttttgtaactacaaattataagaaacattactcagatgtaaggaaataatttttttctgttaacaaaagtgttttttaaaaaaaatcaggtaatatttgttctagtgaatcttctgagtgatacagaaaattataatacagatttgggaattgccttgtttaactccttcactcatccaggcagtctttcaactaatccttctcttttctggattagctttaaggaaatgttaattgctgcttttgtgttctgtttaaattgtcagttacatgtctttgatactcagaatttttctctaagaaattaatgttccttctagcataaaacgaccatcaccagctgaaaagtcacataattcttgggaaaattcagatgatagccgtaataaattgtcgaaaataccttcaacacccaaattaataccaaaagttaccaaaactgc

SEQ ID NO: 414985 - DNA, 3799 bp, Homo sapiens
ttagtgtttcgtagtttttttgttttaattcccacagtgtgaaaacctaagcagaaaaagatcgttgtttcctgcttaaggaatgttttaaggaatcatgattttattgagacctactgttctgatggagtacagcgttgggtgaattttccccaaaacattctttagagatagtctttctaggatacctccatagaccatatacgggtgctgtattcctcagcttctgagttgtaccatggataattcagaagtagcccaggaaaactgtattcctgatgccttatgcacaacttataaccaacacttcattctcaaaaatggagtcactctcatggggacaccagtgacgtgaaataaggccagagggtgtggtatgtgttgcaatgtcctgtaagatacaagtttaagagactgtctttcttggaagtgtctaatacaggtagtaggtgctagtttctggtatctagataggccagaaagtttctcccaggtttcaagtgctgaggatttgctgtgagcctgctcagttttagagggtgtgacactgcttcctctcctttagaaattccaacaaatgtgtattcagaaacagtattggctagctgttgaactgtttatcattcagaactctaaatgctttctaacaatttatctgttattttctagggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttc

SEQ ID NO: 414986 - DNA, 3432 bp, Homo sapiens
cccggcttcgctgcgtttattgcaggtgggtgcacctggtgggagggcaggtccggggcgaggtcacacgacctcgtcggtcaccgggatggggttgacctggggacctcccgggggtccccccgccgccgccgcagcctcctcctcgctgggcttcttgcgggcctcggccgggggccgcggcggggggttgctgggcggctgcttgatggtgcctccgatctgcggccgcaaacgttttttttttttttttttttttttttccattttggggctattttggttttttattagttagattttggacaggacttgatttgaatgaagaacagtgtgagccactgagaaatttgtaaaggaaatgttaacagctaagagtttgaacatagataaaagctaaacagattctaaaataaaataaacatatatagcatcacagttatatttcttcagctaatttttctgcatccctgtgtttccatatcaaaggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttc

SEQ ID NO: 414987 - DNA, 2984 bp, Homo sapiens
atcgagtcggccttgttgggtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttc

SEQ ID NO: 414988 - DNA, 5762 bp, Homo sapiens
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttcaaaaaaaaacaagggggcgctaagtatcctgaagggaccagtaagcgtacagttctgtccaagggccttagggagtgtaaaaacgcagaagcgcattacagcggccgcaacgctgcgaacttgggaggactacttcgggggcatgcacctcaaatagccagggaacaggttggcacccacggaagtgatcataaaagaaaacaaacagaaaaaaaagaataaacaaaacacccacg

SEQ ID NO: 414989 - DNA, 4790 bp, Homo sapiens
  misc_feature (4555)..(4555): n is a, c, g, or t
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaaatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagcctgggtgacagagtgagattccgtctcaacaagaaaaaaaaaaggaatcttctttgtctgtctgttgtttgtaacaacactatttgagaggacccgtagggtgtctgagcccagcacctgagttttagtactgtgttgtcggctcttccaggcctccggtgttgtctttgtgctgtgtggggatgccatgctgctgtattatgatcttggnccggcttcttgagcattcacctcacctgttacagactgttggttttccttttcgggccgtgtttgccaccctggtgttctggcttgtgttctgccgcgtcccctcatcctgtagtgcttgtgtccttgcgaacaaacaggggggctagttccgggccgtctcccttttaagcctagggtaaaagggggtaaggggaccggttggcccgggtggacccacccgatttttagtgtgc

SEQ ID NO: 414990 - DNA, 4494 bp, Homo sapiens
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaaatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgc

SEQ ID NO: 414991 - DNA, 4574 bp, Homo sapiens
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaaatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaaggttttaactgtccccaagtacagagctagggaatggttgtaatgatacctaaattctgtgacttgggaaaaagttagctatccaaggattctgagagaaaaagctggtggctttatttttcccttcttcattgcttataatttatgctttatagcccattggggaataaagaattaaggtcacaatttctcagttaaaactgg

SEQ ID NO: 414992 - DNA, 4672 bp, Homo sapiens
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaaatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaaggctggagtgcaatggcgcaatctcggctcaccgcaacctgcacctcccgtgttcaagagattctcctgctgcagcacccggagtagctgggattacagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaaggttttaactgtccccaagtacagagctagggaatggttgtaatgatacctaaattctgtgacttgggaaaaagttagctatccaaggattctgagagaaaaagctggtggctttatttttcccttcttcattgcttataatttatgctttatagcccattggggaataaagaattaaggtcacaatttctcagttaaaactgg

SEQ ID NO: 414993 - DNA, 3723 bp, Homo sapiens
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgc

SEQ ID NO: 414994 - DNA, 2248 bp, Homo sapiens
  misc_feature (2013)..(2013): n is a, c, g, or t
atcgagtcggccttgttgggtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaaatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagcctgggtgacagagtgagattccgtctcaacaagaaaaaaaaaaggaatcttctttgtctgtctgttgtttgtaacaacactatttgagaggacccgtagggtgtctgagcccagcacctgagttttagtactgtgttgtcggctcttccaggcctccggtgttgtctttgtgctgtgtggggatgccatgctgctgtattatgatcttggnccggcttcttgagcattcacctcacctgttacagactgttggttttccttttcgggccgtgtttgccaccctggtgttctggcttgtgttctgccgcgtcccctcatcctgtagtgcttgtgtccttgcgaacaaacaggggggctagttccgggccgtctcccttttaagcctagggtaaaagggggtaaggggaccggttggcccgggtggacccacccgatttttagtgtgc

SEQ ID NO: 414995 - DNA, 3551 bp, Homo sapiens
  misc_feature (3413)..(3413): n is a, c, g, or t
  misc_feature (3436)..(3436): n is a, c, g, or t
  misc_feature (3438)..(3438): n is a, c, g, or t
  misc_feature (3465)..(3465): n is a, c, g, or t
  misc_feature (3483)..(3483): n is a, c, g, or t
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaaaaacccaaggggnaaggcctgggatcccttaaatgngnggccccaacaaaaattacctgggggancccaaaggggggggtagntggaaaaaacctgggggaaccaaaaaaccagggaggttcccatttgggtttttggaaaaccaaaaccc

SEQ ID NO: 414996 - DNA, 3102 bp, Homo sapiens
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatccgcggatcggcgatcatttcaattagggagatagtaggtattaggagtaggattgttgtgaagtatagtacggatgctacttgtccaatgatggtaaaagggtagcttactggttgtcctccgattcaggttagaatgaggaggtctgcggctaggagtcaataaagtgattggct

SEQ ID NO: 414997 - DNA, 875 bp, Homo sapiens
atgcctggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaatggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgc

SEQ ID NO: 414998 - DNA, 2226 bp, Homo sapiens
  misc_feature (1371)..(1371): n is a, c, g, or t
ctcggcctcccaaagtgctaggattaccggtgtgggcccccgtgcctggccgactcaaccttttaatagcggtatcactttgggcaagttatttaaatctctgtattccaatttcttcatctgttaaatgataattataatagtgtacctgtagtgcataggattaaatgaattaatatgtgtaatacttagaatagtatgtgtaacatagtaaatacacaagttatttgctgctattttcttattttcacagtataagaaaatacctacttaagattcatttggaggcatgtctaaatctagtaatttattagaagcttatccatccctattacttttttaaatggcattagttctgtgtgctattggtgtttatttgcatccacctgtccagttgctctgctgtcttgtgtttttgcagcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaaggtaaatttttaaaaaaccgagtattgtgttttagagtatgttacttgttttgcaggtatttggaactatattggtattagaactatctattcgtaagtcgcaaaagcagatctactagccaaattcagcaaatttagtgatttgtcataatcgttaagatattaacactatagttatacaagataaaatagtcaagcagcttgaagcaatttcaatatttcagacattactatagtcctgaaatgccagagtagatggatgtgtgatctcataattaagactgaacacacttcttggttttcttctttaataaaacatgtaatttcattccatctttaaagctttagaaatctagaggaaaaattcagtaggaatacgactgatgtaactgaagggcttatgttaagttttttggtcttaattgtgtttgtaggattattttagaaaattcaatagcatttataattgctataattgcattataactctttacagtacaagggttgatctctgtgtagatcaagctgtacgttgtaagagaagaatgtaaaatgcattgaagctgggtttatatgagccagaaatggacttctccctctgacaggcatttaaaaagattcaaagtgatagaatggctttaaaaagtctgtgtaatatttgccatactcttaaataacatcacattactctccaactcctctcttaacagttttgttttgagtaagcttcaagcttttagcttnttgggcagaaagatgatgtgatgtttaacttaacattttgaaagaagtagatttgattgtacttaaaaggaatataagttgtcagaaaacctcaaactttaaaaaacataaatgaagatatagattgacttccagttattcagagtaatttaacattgaaacatagggaagttgcatgaaaatgaaatatatcaattttgattcttcatagtaaggtttaccagatgaagtcttgtggttttcctcctactggcgatttctcgatctcctttccaggactttaaatgttggtgttcttcagagttttattccacatgctccactgatactatatgctgctcccatggcctcattttctatctgctgagtcccgtatcagttatctccagcccagatctctaacaggtttaactcatatttctagttgcatcctagacatctttatttgaatgtcctctaccacaaatgaaaatcaccatgttcaaatctgtacataatcatctttcctagcccccaaccaccagtttcatcccttagtgattgactccgcatttcacctagctacctaagctagaaacttggacatcattcatggctctttttacctcacttctcacatccaggtagtcaggaagttctctaaacaccgtgtcccaaatatctgcattatagcactttctagtacaagcgactgcaaaacaattgaaattaacttaatctggccaggggtagtcactcacacctgtaatctcagcactttgggagaccaaagtgggtagatcattagatgtcaggagttcaagaccaccccggccaacatcgtgaagccccatctctactaaaaatacaaaaaaa

SEQ ID NO: 414999 - DNA, 1637 bp, Homo sapiens
ctcggcctcccaaagtgctaggattaccggtgtgggcccccgtgcctggccgactcaaccttttaatagcggtatcactttgggcaagttatttaaatctctgtattccaatttcttcatctgttaaatgataattataatagtgtacctgtagtgcataggattaaatgaattaatatgtgtaatacttagaatagtatgtgtaacatagtaaatacacaagttatttgctgctattttcttattttcacagtataagaaaatacctacttaagattcatttggaggcatgtctaaatctagtaatttattagaagcttatccatccctattacttttttaaatggcattagttctgtgtgctattggtgtttatttgcatccacctgtccagttgctctgctgtcttgtgtttttgcagcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactgtaagtagtgaagtagaacaagttgtaaaattattgggaaattttacttccgttaaaaacaaatttttacatc

SEQ ID NO: 415000 - DNA, 1087 bp, Homo sapiens
  misc_feature (852)..(852): n is a, c, g, or t
cccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagcctgggtgacagagtgagattccgtctcaacaagaaaaaaaaaaggaatcttctttgtctgtctgttgtttgtaacaacactatttgagaggacccgtagggtgtctgagcccagcacctgagttttagtactgtgttgtcggctcttccaggcctccggtgttgtctttgtgctgtgtggggatgccatgctgctgtattatgatcttggnccggcttcttgagcattcacctcacctgttacagactgttggttttccttttcgggccgtgtttgccaccctggtgttctggcttgtgttctgccgcgtcccctcatcctgtagtgcttgtgtccttgcgaacaaacaggggggctagttccgggccgtctcccttttaagcctagggtaaaagggggtaaggggaccggttggcccgggtggacccacccgatttttagtgtgc

SEQ ID NO: 415001 - DNA, 1063 bp, Homo sapiens
cccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcgaaatggggttttgccatgttgcccaggctggtcttgaactctgggctcaagtgatctgcctgcttcagcttcccaaagttctgggattacagggatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaaggctggagtgcaatggcgcaatctcggctcaccgcaacctgcacctcccgtgttcaagagattctcctgctgcagcacccggagtagctgggattacagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaaggttttaactgtccccaagtacagagctagggaatggttgtaatgatacctaaattctgtgacttgggaaaaagttagctatccaaggattctgagagaaaaagctggtggctttatttttcccttcttcattgcttataatttatgctttatagcccattggggaataaagaattaaggtcacaatttctcagttaaaactgg

SEQ ID NO: 415002 - DNA, 706 bp, Homo sapiens
agtactatttaattatgaggagagaactcagcgacactacctgggccatacagactgtgtgaaatggttggtatcatttaacattggttcatttttgttctttcaggccctcattttgtattttttaaatttgggttttattgaaagtgatttcttgtggaaagctcagaatgtaaaaatattatgggtcatctgttgaatatattttaaaaagaaaaaaaggactttcggcctccaaaatggtggtgtggtatcagcagcaacaaaacacatcctccataaatcatgattggaacctcttctgctttctcatgtcgtacagtccttctcttctctggtctgtagtgtgaaacatatatgggacagactggacattttcaggtttctgaaagtgattattggttactcgatatttattgaggatttgtcctatgtagataaattttatacttgaagctttattcttttgggaagaaagaaatctagctgaataaggatcataagtatgccgtaggatgtcatactacaaatgtgagaactccttttaaatgcttttaaattattttgttactttttagttaaatgcaattatttattgtttattaatattttccaacttttattttttatttattacccttttccccacttagatccaaggactgactggatgttttccaacatttaaaagcttttatgtctgtac

SEQ ID NO: 415003 - DNA, 505 bp, Homo sapiens
cagtgcaaattgtattagctgtatgacttagggttttgaattatataataatcacttttctatcgtttgattttttttcatttgtttaaatgtgtattgttccatgttatactttattttacatggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaaggttttaactgtccccaagtacagagctagggaatggttgtaatgatacctaaattctgtgacttgggaaaaagttagctatccaaggattctgagagaaaaagctggtggctttatttttcccttcttcattgcttataatttatgctttatagcccattggggaataaagaattaaggtcacaatttctcagttaaaactggaaaaa

SEQ ID NO: 415004 - DNA, 370 bp, Homo sapiens
ccagggcgaacggacggacgacggaggcgggagccggtagccgagccgggcgacctagagaacgagcgggtcaggctcagcgtcggccactctgtcggtccgctgaatgaagtgcccgcccctctgagcccggagcccggcgctttccccgcaagatggacggtttcgccggcagtctcggtgagtacggctggggagtcctgcgtcttctgcgaagggtaggaacttttttccttccgcacacagcccaggccctgccctcccgcctgcccctcggggtggcagcggctccactgcacatgttcccttcgaggctgccgccctccgcggactccggtggactgagggcccctcccccatgtccaactct

SEQ ID NO: 415005 - DNA, 379 bp, Homo sapiens
tttctaaaagaaataatctctctgaggttttcttggaggtgcttgcctgaaagaaaacctagactccacttcgaagacttggtgttatggctttgtttttgaaccttgtctatacaagtaactgattccctccatccagaaactttaaaaaggaagagcttattgctgaggtgtaagtcaagctgaaagtaaaataaattattagcaccacctgctggttaccattgagtaccattgagtctttaagttttccattttggggctattttggttttttattagttagattttggacaggacttgatttgaatgaagaacagtgtgagccactgagaaatttgtaaaggaaatgttaacagctaagagtttgaacatagat

SEQ ID NO: 415006 - DNA, 362 bp, Homo sapiens
agaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccag

SEQ ID NO: 415007 - DNA, 2254 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtg

SEQ ID NO: 415008 - DNA, 2194 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcga

SEQ ID NO: 415009 - DNA, 634 bp, Homo sapiens
cttgatgctgatgtcgatctaaggatccccccctcacagaatcctctcaaaatgctaataattatatttagtcattttggcctgaaaaattatattccagtagtccatatttgtattcattttctcttgccaagaaactcctgacagttttctcttttccttgatattcgccttcatgtgttttcctaaaaagctgtttttcttcatccttatagtcattgcctgaagatgaaggccatactaggacacttgacacagcaaaagaaatggaggtgattttattttacactttacaagaaatatttaaatggaaaataaggggagtaagagaagtcttgagaatgggaaggcccattgggtaagaaggaaaaaggttagtgagtagagttgtgagggcctagctgaaatggcaaaccataaatgcatatcagtgccaagttgcacaattatacagtttctcccccacaagtttttagcccatatgtaggtagagaaatcaggtggatcaatggagttagagttggagagccataccatagtataaatggaaccattagcttttgattgcttaatatctgggttgatctattcctaaaaagtaatgttgaggttatggaaacccctgagtcttaat

SEQ ID NO: 415010 - DNA, 4542 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgacaccagtaattacttggtaatttaaaaacaagttcataaaaagaaaatacctgcaggtaatttttatggtcagttatattctataacctgaacactgaaaactaaaaacttttacttacaaactattattatctgagcacagcacagtgctttgctttaattggaaataaaaatgcatgagtgagtggtagtcagttatttgttaaactcccaactggggtttctgttgttactgaagaaaaaaacaaatattccaagagtacaaatatgctgacctcagagaggcccagtgcactaatgtgtttctatgttatattagcaacagaaaccttcctgacttgccaggagagcccccgccgggcagccctggtcactgctagatcttgagagcacagatttcagtatagtattcatgtgaaaccagcccttcatgtaaaaagttttggtgtgtaaaaaaggcaacttaagcgaggctaattgcccttaccagcattgttgccatgaaattcctttatacagcaagttcttctattcatactgattccacttatgtgcagcacatgagagctgccactagtctacccagcacctttgtgcaaattagaatacacctgcccttcctcgggctgataaagccacacgacacagcacaggcagacaggttcaattttcgttccctccaccgccacccccgcacttagctgtactcttaatttgcagcccggggcaactcatcccaggaccccaacaagtctggtcagtcacccaatctgcaaccctgtataatcatcttgtaaaggctcctgtatgcaagactttgtgtagaactttacggggttcatggggacacctagctaagaatccctgctatgtagggaaactgagtgcattagaaatcctggcgatgctctggtgatgaggccaccggttaagtcttccggttatgaagtccattcagaaaaagtcacgggcagtttggtcatttctcaccctgttgttacagt

SEQ ID NO: 415011 - DNA, 3777 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgacaccagtaattacttggtaatttaaaaacaagttcataaaaagaaaatacctgcaggtaatttttatggtcagttatattctataacctgaacactgaaaactaaaaacttttacttacaaactattattatctgagcacagcacagtgctttgctttaattggaaataaaaatgcatgagtggaagataaaaagaaaaaaaaatagtagatctcgagactagttctcctcgtgccgaa

SEQ ID NO: 415012 - DNA, 4434 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgacaccagtaattacttggtaatttaaaaacaagttcataaaaagaaaatacctgcaggtaatttttatggtcagttatattctataacctgaacactgaaaactaaaaacttttacttacaaactattattatctgagcacagcacagtgctttgctttaattggaaataaaaatgcatgagtgagtggtagtcagttatttgttaaactcccaactggggtttctgttgttactgaagaaaaaaacaaatattccaagagtacaaatatgctgacctcagagaggcccagtgcactaatgtgtttctatgttatattagcaacagaaaccttcctgacttgccaggagagcccccgccgggcagccctggtcactgctagatcttgagagcacagatttcagtatagtattcatgtgaaaccagcccttcatgtaaaaagttttggtgtgtaaaaaaggcaacttaagcgaggctaattgcccttaccagcattgttgccatgaaattcctttatacagcaagttcttctattcatactgattccacttatgtgcagcacatgagagctgccactagtctacccagcacctttgtgcaaattagaatacacctgcccttcctcgggctgataaagccacacgacacagcacaggcagacaggttcaattttcgttccctccaccgccacccccgcacttagctgtactcttaatttgcagcccggggcaactcatcccaggaccccaacaagtctggtcagtcacccaatctgcaaccctgtataatcatcttgtaaaggctcctgtatgcaagactttgtgtagaactttacggggttcatggggacacctagctaagaatccctgctatgtagggaaactgagtgcattagaaatcctggcgatgctctggtgatgaggccaccggttaagtcttccggttatgaagtccattcagaaaaagtcacgggcagtttggtcatttctcaccctgttgttacagt

SEQ ID NO: 415013 - DNA, 4380 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgacaccagtaattacttggtaatttaaaaacaagttcataaaaagaaaatacctgcaggtaatttttatggtcagttatattctataacctgaacactgaaaactaaaaacttttacttacaaactattattatctgagcacagcacagtgctttgctttaattggaaataaaaatgcatgagtgagtggtagtcagttatttgttaaactcccaactggggtttctgttgttactgaagaaaaaaacaaatattccaagagtacaaatatgctgacctcagagaggcccagtgcactaatgtgtttctatgttatattagcaacagaaaccttcctgacttgccaggagagcccccgccgggcagccctggtcactgctagatcttgagagcacagatttcagtatagtattcatgtgaaaccagcccttcatgtaaaaagttttggtgtgtaaaaaaggcaacttaagcgaggctaattgcccttaccagcattgttgccatgaaattcctttatacagcaagttcttctattcatactgattccacttatgtgcagcacatgagagctgccactagtctacccagcacctttgtgcaaattagaatacacctgcccttcctcgggctgataaagccacacgacacagcacaggcagacaggttcaattttcgttccctccaccgccacccccgcacttagctgtactcttaatttgcagcccggggcaactcatcccaggaccccaacaagtctggtcagtcacccaatctgcaaccctgtataatcatcttgtaaaggctcctgtatgcaagactttgtgtagaactttacggggttcatggggacacctagctaagaatccctgctatgtagggaaactgagtgcattagaaatcctggcgatgctctggtgatgaggccaccggttaagtcttccggttatgaagtccattcagaaaaagtcacgggcagtttggtcatttctcaccctgttgttacagt

SEQ ID NO: 415014 - DNA, 4430 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgacaccagtaattacttggtaatttaaaaacaagttcataaaaagaaaatacctgcaggtaatttttatggtcagttatattctataacctgaacactgaaaactaaaaacttttacttacaaactattattatctgagcacagcacagtgctttgctttaattggaaataaaaatgcatgagtgagtggtagtcagttatttgttaaactcccaactggggtttctgttgttactgaagaaaaaaacaaatattccaagagtacaaatatgctgacctcagagaggcccagtgcactaatgtgtttctatgttatattagcaacagaaaccttcctgacttgccaggagagcccccgccgggcagccctggtcactgctagatcttgagagcacagatttcagtatagtattcatgtgaaaccagcccttcatgtaaaaagttttggtgtgtaaaaaaggcaacttaagcgaggctaattgcccttaccagcattgttgccatgaaattcctttatacagcaagttcttctattcatactgattccacttatgtgcagcacatgagagctgccactagtctacccagcacctttgtgcaaattagaatacacctgcccttcctcgggctgataaagccacacgacacagcacaggcagacaggttcaattttcgttccctccaccgccacccccgcacttagctgtactcttaatttgcagcccggggcaactcatcccaggaccccaacaagtctggtcagtcacccaatctgcaaccctgtataatcatcttgtaaaggctcctgtatgcaagactttgtgtagaactttacggggttcatggggacacctagctaagaatccctgctatgtagggaaactgagtgcattagaaatcctggcgatgctctggtgatgaggccaccggttaagtcttccggttatgaagtccattcagaaaaagtcacgggcagtttggtcatttctcaccctgttgttacagt

SEQ ID NO: 415015 - DNA, 2975 bp, Homo sapiens
cgctgttccaaagtttaattaaaaacacaatttacaaatatttaatatcttctgaaaagcatttctaagttaagaatgaaaaagtatgtacataatatataatcaaataccaggcagcctcaacttccaccaggtccacactcagcaacatccgtctttttaggttcttcagtgtcttctgtcaaatccacaaagttgttttccatgacgagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgacaccagtaattacttggtaatttaaaaacaagttcataaaaagaaaatacctgcaggtaatttttatggtcagttatattctataacctgaacactgaaaactaaaaacttttacttacaaactattattatctgagcacagcacagtgctttgctttaattggaaataaaaatgcatgagtgagtggtagtcagttatttgttaaactcccaactggggtttctgttgttactgaagaaaaaaacaaatattccaagagtacaaatatgctgacctcagagaggcccagtgcactaatgtgtttctatgttatattagcaacagaaaccttcctgacttgccaggagagcccccgccgggcagccctggtcactgctagatcttgagagcacagatttcagtatagtattcatgtgaaaccagcccttcatgtaaaaagttttggtgtgtaaaaaaggcaacttaagcgaggctaattgcccttaccagcattgttgccatgaaattcctttatacagcaagttcttctattcatactgattccacttatgtgcagcacatgagagctgccactagtctacccagcacctttgtgcaaattagaatacacctgcccttcctcgggctgataaagccacacgacacagcacaggcagacaggttcaattttcgttccctccaccgccacccccgcacttagctgtactcttaatttgcagcccggggcaactcatcccaggaccccaacaagtctggtcagtcacccaatctgcaaccctgtataatcatcttgtaaaggctcctgtatgcaagactttgtgtagaactttacggggttcatggggacacctagctaagaatccctgctatgtagggaaactgagtgcattagaaatcctggcgatgctctggtgatgaggccaccggttaagtcttccggttatgaagtccattcagaaaaagtcacgggcagtttggtcatttctcaccctgttgttacagt

SEQ ID NO: 415016 - DNA, 3345 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgtccccgtacatcgttagaagcttgaattcgagcagtagtagtagtaggcggccgc

SEQ ID NO: 415017 - DNA, 1441 bp, Homo sapiens
gcggccgcctactactactaaattcgcggccgcgtcgacttttttatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgacaccagtaattacttggtaatttaaaaacaagttcataaaaagaaaatacctgcaggtaatttttatggtcagttatattctataacctgaacactgaaaactaaaaacttttacttacaaactattattatctgagcacagcacagtgctttgctttaattggaaataaaaatgcatgagtgagtggtagtcagttatttgttaaactcccaactggggtttctgttgttactgaagaaaaaaacaaatattccaagagtacaaatatgctgacctcagagaggcccagtgcactaatgtgtttctatgttatattagcaacagaaaccttcctgacttgccaggagagcccccgccgggcagccctggtcactgctagatcttgagagcacagatttcagtatagtattcatgtgaaaccagcccttcatgtaaaaagttttggtgtgtaaaaaaggcaacttaagcgaggctaattgcccttaccagcattgttgccatgaaattcctttatacagcaagttcttctattcatactgattccacttatgtgcagcacatgagagctgccactagtctacccagcacctttgtgcaaattagaatacacctgcccttcctcgggctgataaagccacacgacacagcacaggcagacaggttcaattttcgttccctccaccgccacccccgcacttagctgtactcttaatttgcagcccggggcaactcatcccaggaccccaacaagtctggtcagtcacccaatctgcaaccctgtataatcatcttgtaaaggctcctgtatgcaagactttgtgtagaactttacggggttcatggggacacctagctaagaatccctgctatgtagggaaactgagtgcattagaaatcctggcgatgctctggtgatgaggccaccggttaagtcttccggttatgaagtccattcagaaaaagtcacgggcagtttggtcatttctcaccctgttgttacagt

SEQ ID NO: 415018 - DNA, 1980 bp, Homo sapiens
  misc_feature (314)..(314): n is a, c, g, or t
  misc_feature (366)..(366): n is a, c, g, or t
  misc_feature (405)..(405): n is a, c, g, or t
ccacgcgtccgggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagngaaagaaaggagagaagcagattccaggggaagaaaaggggagaaaacgganaagagttaaggaggataaaaagaagcgagatcgagaccnggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggaggtgattttattttacactttacaagaaatatttaaatggaaaataaggggagtaagagaagtcttgagaatgggaaggcccattgggtaagaaggaaaaaggttagtgagtagagttgtgagggcctagctgaaatggcaaaccataaatgcatatcagtgccaagttgcacaattatacagtttctcccccacaagtttttagcccatatgtaggtagagaaatcaggtggatcaatggagttagagttggagagccataccatagtataaatggaaccattagcttttgattgcttaatatctgggttgatctattcctaaaaagtaatgttgaggttatggaaacccctgagtcttaat

SEQ ID NO: 415019 - DNA, 420 bp, Homo sapiens
atctgtttttaatgtataaactactcttagttttctttttatcttgtctaaagaattaataaagatttcctgtgtgcagaagagccacaatgatcacctgataatgcgcgtagtcttcagccttggatgtggtgaagaagggctctcagcagttatgcttctggatggcagcttgactttcatgtcccctttttaattaaaaggtaaaaacaatgttgaattaagtgatgtctttttctttcagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcga

SEQ ID NO: 415020 - DNA, 635 bp, Homo sapiens
gatcagattctaatttgacaggcaaccagtcaatgaaacagacacacctgcacagttggaaatggaggatgaagatacaattgatgtgtttcagcaacagacaagaagtgtctactgaaaaaggaacctgcttctttactctagaactttgttcttatagaccaagattacattctcaattagaaaactgcaatttggttccaccacatcatgactattactatagtatagttttctctattcttttatttttcccttacccattcccttattgtacataaaataatgggtgtatgttcacaagcattttgctgttttaaatattaaatggccaatgacatccacttgatgtcaatcaaaacatatctgtggggaaaaataccgattcttgaaaattacctccctttctccatcagtggcatgctcattcaactcttatcttacattgcaatgttattttgttctcactattttaacaaaaaaaaaaaatccttgcataccttattcaattggagaattttaatgtttttcatttatcattgtaaaaccaaggacaattttataacttttcgtgtatatagctcttacatgtagggcaatctgtctttaactagagataaattactcttaaaaaa

SEQ ID NO: 415021 - DNA, 1870 bp, Homo sapiens
cttgcgttgcacccgggctgagtgcggccgcgacggggcgggcggactctcgggcgctcagagctggcctcgggtcctcggagcctggcgctcgaacctcccttccgacctccacccggaccccgaccccgacccggcctggcccggcccccgcccccgccccccgggccgatggactactcctacctcaattcgtacgactcgtgcgtggcggccatggaggcgtccgcctacggcgactttggcgcctgcagccagcccggcggcttccaatacagccccctgcggcccgctttccccgcggcagggccgccctgccccgcgctcggctcctccaactgcgcacttggcgccctacgcgaccaccagcccgcgccctactcggcagtgccatacaatttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctagctgccggcctctggaggctccgagcctgcccccagagacgtccctgcccctccaggacctgacagcccctcccatcctggccacccgcctggaagtccccatccgtctccactccctactgtctcacccctcggtgtgtcctccccaactttggagaccaagtcagggccactctcgtcctcacccaccctctaccagcagagcggagttctttataccgggacctcctccaggagaaccccggagctccttctagcttggccttctttggatgcggtatcacatgaggcctgtccctaacagtgccctcaaagtgaaggtcctcaaggaggatcggcacagcccccttccctggctctgcagcggctgggtcaccccttacgctggtgatcaggaaagcccgctgccccacccctcgggcccacccgtacagaggctggtggtcgccgggataattaatgaccaccgccaattcatccctcacgtgtctcctctcttccctagcccgtctggcacagagggtggacctgttagaggagtggaggggctgcctggggaatgggacagagggattctctttccctaatttttttggttgtcctttttctttgaaaaacttgtaatttattgaagttttactcaatccaaataaaacttaatttattgaagacatcacgccgcaacccttacgactgcccaggaggctgcttgcaagaccctgtcccgggctgagacctgcgaggaacctccctcccccaccctgccgccgtgcatccccagagcagggcagcacagaccaggagacagtgagaactaagcaaactggcactttatggctgagatc

SEQ ID NO: 415022 - DNA, 1494 bp, Homo sapiens
ctcggagcgcaggctcagctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggtttgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaac

SEQ ID NO: 415023 - DNA, 1397 bp, Homo sapiens
agggacgggagtcggaggctgagagactgcccagacacacaaaaaatgtggcctgaggaaagccccaagagggaggagaggaaagatgaggcaactgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggtttgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaac

SEQ ID NO: 415024 - DNA, 778 bp, Homo sapiens
ccgccatttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatgaaaaaaaa

SEQ ID NO: 415025 - DNA, 760 bp, Homo sapiens
gaggagaggaagaggagcatgcccttcatggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatgaaaaaaaa

SEQ ID NO: 415026 - DNA, 811 bp, Homo sapiens
gaggagaggaagaggagcatgcccttcatggtggtaaatggaaatcccttctatgagtacgggcaccggcttcccctacagatggtcacccacctgcaagtggatggggatctgcaacttcaatcaatcaacttcatcggaggccagcccctccggccccaggggttgcagcccaaggtgtactaacccagcacctagagaaacgccggagtctaatgggtgtgtcatagatatctgtcgactcttggagaataatatcgcttcttcctcacttcacagaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatgaaaaaaaa

SEQ ID NO: 415027 - DNA, 516 bp, Homo sapiens
ccccgattatgaatggcggaggcgtgaatggcgtacgcgttgaaggccggaggcgtagaatggccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatgaaaaaaaa

SEQ ID NO: 415028 - DNA, 575 bp, Homo sapiens
ccgccatttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggtggcagaattgggatcctctagatcac

SEQ ID NO: 415029 - DNA, 353 bp, Homo sapiens
  misc_feature (5)..(5): n is a, c, g, or t
cagcnactaggctgagtaggggattccccacgcacctgtcaactgtctaatgaccttcattcctgcgcgtgtcttcagcacccccggggcacttggtgtttgttctctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatgaaaaaaaa

SEQ ID NO: 415030 - DNA, 2350 bp, Homo sapiens
gaaacttaaaggtgtttaccttgtcatcagcatgtaagctaattatctcgggcaagatgtaggcttctattgtcttgttgctttagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggttttttttttaaaaaaaagaaaatgaaaaacaaccaagcgcatccaatctcaaggaatctttaagcagagaagggcataaaacagctttgggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggattttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaccctcctttt

SEQ ID NO: 415031 - DNA, 762 bp, Homo sapiens
ggaagcacgcgtcctctccgtccacgccgcgtgcgtccctagggggtcccgcactgcagagccccactgcagtgacagaaataagcccaccgacgacaggagcccaacccgaacccagcacgacaactaactcgctggaccatccgctcgactatgcggcaaagggggccttctcctacggccccgccgaagaccgtcgaggctctggtcgatacgctgctctgtgtggtcgccgccgtgccggtccgccagtgtgtgtggggggctgtcctgtgggccctctccttggtggggtgcggagcccctcggtgccccgctagcgttctggctgcgcggtgtagctctccctcgcgctctgctctcttctctctctctctctctctgctctctctctctctctctctctctctctctctctctctctctctctctctctctctctcggcacgagagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcaggtgaaacccccaccctgtccctcagccccctcctcctaaagacctgtccgtgcccggggaaccccgaccgaattggaaagtggttccactttgtaactccgcaagttggttgcaaagcagcattcaccttccttcctctcaac

SEQ ID NO: 415032 - DNA, 2641 bp, Homo sapiens
ggaagcacgcgtcctctccgtccacgccgcgtgcgtccctagggggtcccgcactgcagagccccactgcagtgacagaaataagcccaccgacgacaggagcccaacccgaacccagcacgacaactaactcgctggaccatccgctcgactatgcggcaaagggggccttctcctacggccccgccgaagaccgtcgaggctctggtcgatacgctgctctgtgtggtcgccgccgtgccggtccgccagtgtgtgtggggggctgtcctgtgggccctctccttggtggggtgcggagcccctcggtgccccgctagcgttctggctgcgcggtgtagctctccctcgcgctctgctctcttctctctctctctctctctgctctctctctctctctctctctctctctctctctctctctctctctctctctctctctcggcacgagagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggttttttttttaaaaaaaagaaaatgaaaaacaaccaagcgcatccaatctcaaggaatctttaagcagagaagggcataaaacagctttgggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggattttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaccctcctttt

SEQ ID NO: 415033 - DNA, 2786 bp, Homo sapiens
ggaagcacgcgtcctctccgtccacgccgcgtgcgtccctagggggtcccgcactgcagagccccactgcagtgacagaaataagcccaccgacgacaggagcccaacccgaacccagcacgacaactaactcgctggaccatccgctcgactatgcggcaaagggggccttctcctacggccccgccgaagaccgtcgaggctctggtcgatacgctgctctgtgtggtcgccgccgtgccggtccgccagtgtgtgtggggggctgtcctgtgggccctctccttggtggggtgcggagcccctcggtgccccgctagcgttctggctgcgcggtgtagctctccctcgcgctctgctctcttctctctctctctctctctgctctctctctctctctctctctctctctctctctctctctctctctctctctctctctcggcacgagagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggttttttttttaaaaaaaagaaaatgaaaaacaaccaagcgcatccaatctcaaggaatctttaagcagagaagggcataaaacagctttgggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggattttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaccctcctttt

SEQ ID NO: 415034 - DNA, 3832 bp, Homo sapiens
  misc_feature (1492)..(1492): n is a, c, g, or t
  misc_feature (1496)..(1496): n is a, c, g, or t
  misc_feature (2174)..(2175): n is a, c, g, or t
ggaagcacgcgtcctctccgtccacgccgcgtgcgtccctagggggtcccgcactgcagagccccactgcagtgacagaaataagcccaccgacgacaggagcccaacccgaacccagcacgacaactaactcgctggaccatccgctcgactatgcggcaaagggggccttctcctacggccccgccgaagaccgtcgaggctctggtcgatacgctgctctgtgtggtcgccgccgtgccggtccgccagtgtgtgtggggggctgtcctgtgggccctctccttggtggggtgcggagcccctcggtgccccgctagcgttctggctgcgcggtgtagctctccctcgcgctctgctctcttctctctctctctctctctgctctctctctctctctctctctctctctctctctctctctctctctctctctctctctcggcacgagagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccagtaagtgaggccgccccactgcggggccgcgggctgagctcaggaggtgcggcgagagctccagaaggcgcggcgccggcaggctgcgcgtgggcatcagggagggcggcccggcagcggcgccagggacttgggtgcgggagctggggatgcttcccctgctcggctggggtccaagaacaggcacttggtagcgctggggtcctgcggtcagatgcgggtactcggcgtctcctaggcgcggnggantggcagctctctcggcgcagaagacctcggggagccaagggaagcgaccccgagctcaaggagcaggggcgagcagagcgcggagaggctagaccgggccaggagggaggctgccctgttgggaggcactcgagcgcccggcccggccctctctccagcggagtctggcaggtgggaggactcgcagttccagagggactctaagggtccgagcaggtgccctcactggggcctgacaggagagaagccaagaggcaaagcgtctgggggctccagcttttggaagtcaacaccccctctcctaacctctccaaactggggtctaccgtagaccccagctcccggcctgagcccagttcgccgcctgtggcagctaatcctaatgctctgacccgggctgggcacgaaaggagcagaagcgcctttcccccactgcgtcttttggttcgaaagaggaactgagactgagggagggcagccagggttggggctgtgagcgctccagtacagccccctcgacggtacggcctggggcaggcgctggcagttccccgcggatggcctcttgggccccagcgctaggctgcctgggtcaggagggcgccgtcggttggggcgggccgggcggccaatggcgcggaaaacagggtggcctggctcggcctggccccggccgannctgtgcgtttgtcgcttacagtctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggttttttttttaaaaaaaagaaaatgaaaaacaaccaagcgcatccaatctcaaggaatctttaagcagagaagggcataaaacagctttgggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggattttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaccctcctttt

SEQ ID NO: 415035 - DNA, 2550 bp, Homo sapiens
ggaagcacgcgtcctctccgtccacgccgcgtgcgtccctagggggtcccgcactgcagagccccactgcagtgacagaaataagcccaccgacgacaggagcccaacccgaacccagcacgacaactaactcgctggaccatccgctcgactatgcggcaaagggggccttctcctacggccccgccgaagaccgtcgaggctctggtcgatacgctgctctgtgtggtcgccgccgtgccggtccgccagtgtgtgtggggggctgtcctgtgggccctctccttggtggggtgcggagcccctcggtgccccgctagcgttctggctgcgcggtgtagctctccctcgcgctctgctctcttctctctctctctctctctgctctctctctctctctctctctctctctctctctctctctctctctctctctctctctcggcacgagagacacgtagaccaacagtgcggccccagggttcgtccccagactcgctcgctcatttgttggcgactggggctcagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggttttttttttaaaaaaaagaaaatgaaaaacaaccaagcgcatccaatctcaaggaatctttaagcagagaagggcataaaacagctttgggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggattttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaccctcctttt

SEQ ID NO: 415036 - DNA, 1015 bp, Homo sapiens
agctgtgggtgtatggtgagttgatgttgtccctgacttagggaatatttataaacaagggcagaggtatcccctggacatgttagggacagcgctttaatggacagagggtgaaagatcaggaaaggcagggggttctttccccccagacatatcagtgattggctggctttgctttatcctgggtaaatttagactgctttgcaaatgagtaaaattattgacatttcctaaaaggctcacggtacattagtagactatattatttttataaaaagctctttcctctgcctccccaagggaaaagtgaaccagctcttcagaggaggagagcatcttaaacagacgagatggatgagctggctcttggcttgcaggctaatcttgctgatctctctcttaggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtga

SEQ ID NO: 415037 - DNA, 718 bp, Homo sapiens
tcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtga

SEQ ID NO: 415038 - DNA, 6169 bp, Homo sapiens
gtgctcgcttcggcagcacatatactaaaattggaacgatacagagaagattagcatggcccctgcgcaaggatgacacgcaaattcgtgaagcgttccatattttttccccaaccaggatttgaacagagacgtgaatgtctaaccttttgattctattccttttattccagcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggcgagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagagaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacaggggaaccttaggagcaaataaaccgtgctttcatgttttttaaatggtgctttccttacccgagaggtattttgcctgttccaatcgaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctggcaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattcagaaaaatg

SEQ ID NO: 415039 - DNA, 3511 bp, Homo sapiens
acagaaagcagctcatgcttctccactcttcccctagatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagagaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacaggggaaccttaggagcaaataaaccgtgctttcatgttttttaaatggtgctttccttacccgagaggtattttgcctgttccaatcgaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctggcaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattcagaaaaatg

SEQ ID NO: 415040 - DNA, 3232 bp, Homo sapiens
tactttcgggccctgactgatctaccttggagaacctgatccttagactccagcaggatgtcttatcgaccgcatcagtgcaaacagccctgccagccaccttctgttgtactttaattattgttttgccttgttgctgtgacctccctaagacactgaagatacttctcgggaaaggatcatcgccgttgaaatgaaaagagagacagagagagaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacaggggaaccttaggagcaaataaaccgtgctttcatgttttttaaatggtgctttccttacccgagaggtattttgcctgttccaatcgaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctggcaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattcagaaaaatg

SEQ ID NO: 415041 - DNA, 2561 bp, Homo sapiens
tcccagacaggctcatggcggcgaggcatgacagctcaggtgggcatcaccatgccaaggacgaagccttcagccccggcaggcgcactgaagaccccaggaactggtaagaggccggggctgtcttggccctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctggcaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattcagaaaaatg

SEQ ID NO: 415042 - DNA, 1604 bp, Homo sapiens
gtgctcgcttcggcagcacatatactaaaattggaacgatacagagaagattagcatggcccctgcgcaaggatgacacgcaaattcgtgaagcgttccatattttttccccaaccaggatttgaacagagacgtgaatgtctaaccttttgattctattccttttattccagcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctgtaagtctgtctgtctagtcagataacatctttggcccctgagaaccttctccagtaggaatggctaggagtcctgttatgacacatctgctccttgggatcctttatgctttgctttaataggactgtgcatgttctttcaatgctttaggactgggaaagttgaaagagaaaagaaacttaggttttcgttctgatggtgtcaatatccataactaactggttggccttaagcgggttacttaaattctctttgtttccatacctctatatatcaatttgggataatggtttttgtgtacgtatcctagccctaagaattggacgagataaatggatatacaggagcttgcttcctgcagcagtaagaaaggctggccctgctcagtagggctgaatttcttttgaaaccatggtgttccaggtctagaattaaagaactggagcacaggtagtctgcaaggaaagttgtcagagagatgagacagtgcatgggagaagagggaagtcatggccagggtcaggacagccactgagatagggttagagaaagaagtttggttgtataaacttca

SEQ ID NO: 415043 - DNA, 1080 bp, Homo sapiens
tcccagacaggctcatggcggcgaggcatgacagctcaggtgggcatcaccatgccaaggacgaagccttcagccccggcaggcgcactgaagaccccaggaactggtaagaggccggggctgtcttggccctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacaggtaatgacattgcaggccggggaccaaccgagcctctaggttcttctgcccattcgttgtcaagccagatgtcttgtgcgaggctgttggcctaagccacctgcttgtgtttgtggctctagtgtactctgtgacacatggacatgccagtgagagtctgttcctctgtctgctaaagcccagggagaggtggagttgggctggcctcttcattcccattttgggaaggcgaccttaaaccctgccacttgatctggggcagcggaagctctcgcttgcatctcttgtggcctcctgtggcatgttcctgcttttcagcttccttcccattccttttgccacccccaaccccaagcccagaaatgacctgccacccactgtgtagcttggccctcacctttgtctacccctccccatgcagctgcctcttctccctttcaaaatcctttgctgaagtttggctcattatgtcttgcagactgttgtgttctgtgtgcccatttcctgcgatgataatgaaaaagaatgtgtagagtattaagactttacaaatgtacacgcttgtgtttgcccccagctgtaggtgggcctcagagatggatactgtccttaattttgtgggggagtgatgacctggccaaacataacaaacagatgttgt

SEQ ID NO: 415044 - DNA, 621 bp, Homo sapiens
tcccagacaggctcatggcggcgaggcatgacagctcaggtgggcatcaccatgccaaggacgaagccttcagccccggcaggcgcactgaagaccccaggaactggtaagaggccggggctgtcttggccctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccag

SEQ ID NO: 415045 - DNA, 510 bp, Homo sapiens
tcccagacaggctcatggcggcgaggcatgacagctcaggtgggcatcaccatgccaaggacgaagccttcagccccggcaggcgcactgaagaccccaggaactggtaagaggccggggctgtcttggccctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccag

SEQ ID NO: 415046 - DNA, 244 bp, Homo sapiens
ctggagtgtcctgtattgctgatgttctcctcccctgtcccctttttggttccataacagccatctatcaattcaccttttttttttcttttaatagttcatggatcctcactctccttggtttccagcacatcgtcagtttattctacagtgagtataaatcaatgctgtgtggctgtgatcatgagaactggggttcctttatcaaatgtgtcaagaataaaatatatgcatttatcctagg

SEQ ID NO: 415047 - DNA, 394 bp, Homo sapiens
tgaccttttaggagtccagggtgggccgccaactagacagaaagcagctcatgcttctccactcttcccctagatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttcctt

SEQ ID NO: 415048 - DNA, 301 bp, Homo sapiens
gcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaaggttggtgctgtgcctctggctgcctttctcagaaagacacccttccaaaaataaaaagattagcttaggaatcccaaatgtcgaatagcctttgcctgtaagatttc

SEQ ID NO: 415049 - DNA, 392 bp, Homo sapiens
gacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagac

SEQ ID NO: 415050 - DNA, 1403 bp, Homo sapiens
gagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgggagtatttttataaagcctttttgtacagattaatcggccatgtccaggttattggttttgatattttataggacatttgagtggtgtggcgatgtgtagagaatgtgccagagctgcagagacagtccattctgggctgctggctttttgcccttcctgcatgatttccagctactgtgacctggatgctgggaacccaggcatcggctccaaaaattagaaggcgagtgctgagaagacttgtcacaggtttctcaaatcagaatatactcagtcatagtggttccctgggaagccccagaccctttgacttgtgacattactggtttgcagacataataactacactcagaggaccatggaggcagagggatcatggtttcagggcactgaaaactctacgagccaagaggactagtgcatggactgaaagtcaggcatgccctcaaataggctgtattttctttccaggaatgtaacctttcccctttttcttctgacctgagccaagattggaaatcagaaagtctcctgtacatggagctgaagaggggctgctgttttccgaatgttttccatttcacaggcgccacctgcttgcccggggttggtcttgagaagacacccaaatgttcatgcctcagaaaggcagcagaatgccttttaggaaatttttttaaagtaatttgaagttatatagaagtttggtaagaagaagcagttgtttctctcttttctccctcatttcatggaggtgttaatgatcatggctggccgtgatgtacacatgggctgattttcattttttcagtttcatagctgagaaattcagctttgttttagttgaatcatcatattggaaagcagacattgaaagttttcttttctatctttgttatgaatgtgctatggccccttttggagacttctattgggtaatattctatgtgagagaaggaaacttggtattaaatgttgtggaaaataataatgatgataataataaagtatatgctgcaatggtgtactgccaatcagattgcttgggagaagaaaatttattcaaatccaacgataaaaaattaatttcttattgaataaacagtatgttcccatata

SEQ ID NO: 415051 - DNA, 1506 bp, Homo sapiens
caaccaggcacttagccatttatgtattgtctatgagtgcttttgcactacagtggcagagttgagtagttgtgaaaagccacgtggcctgcaaagcctggaatatttactatttggttctttacagaaaaactttgtcaacccctgttctgaggttcttaactcagggttggttttcatctctctttttttaaactttttaaaaaaatttaggggtacatgtgcaggtttgttacataggcaaacctgtgtcatgggagtttgttgtacagattatttcgtcacccaggtattaagcctagtacccattggttattcttcctgatcctctccctcggcctcccaaagtgctgggattacaggcgtgagccaccgcgcccggccgggagtatttttataaagcctttttgtacagattaatcggccatgtccaggttattggttttgatattttataggacatttgagtggtgtggcgatgtgtagagaatgtgccagagctgcagagacagtccattctgggctgctggctttttgcccttcctgcatgatttccagctactgtgacctggatgctgggaacccaggcatcggctccaaaaattagaaggcgagtgctgagaagacttgtcacaggtttctcaaatcagaatatactcagtcatagtggttccctgggaagccccagaccctttgacttgtgacattactggtttgcagacataataactacactcagaggaccatggaggcagagggatcatggtttcagggcactgaaaactctacgagccaagaggactagtgcatggactgaaagtcaggcatgccctcaaataggctgtattttctttccaggaatgtaacctttcccctttttcttctgacctgagccaagattggaaatcagaaagtctcctgtacatggagctgaagaggggctgctgttttccgaatgttttccatttcacaggcgccacctgcttgcccggggttggtcttgagaagacacccaaatgttcatgcctcagaaaggcagcagaatgccttttaggaaatttttttaaagtaatttgaagttatatagaagtttggtaagaagaagcagttgtttctctcttttctccctcatttcatggaggtgttaatgatcatggctggccgtgatgtacacatgggctgattttcattttttcagtttcatagctgagaaattcagctttgttttagttgaatcatcatattggaaagcagacattgaaagttttcttttctatctttgttatgaatgtgctatggccccttttggagacttctattgggtaatattctatgtgagagaaggaaacttggtattaaatgttgtggaaaataataatgatgataataataaagtatatgctgcaatggtgtactgccaatcagattgcttgggagaagaaaatttattcaaatccaacgataaaaaattaatttcttattgaataaacagtatgttcccatata

SEQ ID NO: 415052 - DNA, 3309 bp, Homo sapiens
ctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 415053 - DNA, 3365 bp, Homo sapiens
ctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggttgctgttaacattttgggtccactgtatctagacatgtccttcaaaagttgcattttttgggaataacatttcttggaattggactgtgggcatggaatgaaaaaggaagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 415054 - DNA, 3301 bp, Homo sapiens
ctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggttgctgttaacattttgggtccactgtatctagacatgtccttcaaaagttgcattttttgggaataacatttcttggaattggactgtgggcatggaatgaaaaaggaagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatatattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 415055 - DNA, 404 bp, Homo sapiens
tagccaggtgaatgtgtctgtgggtatgtttggtgtgttgatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 415056 - DNA, 370 bp, Homo sapiens
ttttaccacatatgaattacatcttaaatttcaaaaatcaatgatttaaaaaaatgggacacagtggccagggaaacaagttacaagtgtcactgtttcactcacattttcttcctttctcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaa

SEQ ID NO: 415057 - DNA, 3733 bp, Homo sapiens
ctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctaccttaaaaaaaaaaaaagaaaaaaaaaacagagacacacaccaagacaagacccaacaaaacgacacacaacgaaatcaaaataaagaaaaaaaagaggggggcaaagcaaaaacaccacagggcagagagcgtaaaagagaaccagaatattgaaaagaaagcggcacatgtggacaagacaaagagcccaaggcggaaatatcacggagtgggaagaaaaagcagcacgtacgcggaaccccactcggtggagggatagggcaagacacaagcaaagagcaaggccaacaaaagagcgtgtacacaaccgactcgagaaacacgagcgtatgacaaccaagcacaaaacctgcacacgagcagccggcgacacgcacacagagcgaacacaagcaaggagagacccacaagagaagaaagcacaatg

SEQ ID NO: 415058 - DNA, 2823 bp, Homo sapiens
  misc_feature (3)..(3): n is a, c, g, or t
  misc_feature (75)..(75): n is a, c, g, or t
gantgccgtcggtatatggtcctgtaattgcacgtaaataacgtttcctgcacgctctcctcttcagctggaaangcctcccttttttgggaataacatttcttggaattggactgtgggcatggaatgaaaaaggagttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 415059 - DNA, 183 bp, Homo sapiens
ctagaaaagtctttggtaattaaaaaatcacacgcgtttgcccagaatgactgtgctagggttagcagtaatactgcttagttattaggtacagcaaagttcttaccttggagtttctgtcattgttggttggtgctttgtaaatatgccttatacttctgctggaaacagctaacagacagg

SEQ ID NO: 415060 - DNA, 1188 bp, Homo sapiens
cggtacccaagcttttaccgcacacacacacagacataaaataaccaaacatctcatttctaggaaagagataacactaaaggcatcataggtttaactgaaatacgttatatgaagttttacaaaaaggtcaacagaaagctcatttgtgaaaacatactctcatgggagcttctttaacattagttcagaggttaatatatttcctggaggtgttttcctagaattgattgcactattgcatggtaataacatttaattgttaaggaaacattatatataggttcaaattatcccttaatgttgatttctccccttttccatggattttgatactaagaaacaaaatgctttgagattttggtaactattttgattttgataaaacatgttaaaatagaaggacatgatatttttctatagtttccatcaggaagagtacatcagaaacttctccataaggaaagaaaactgactctctcttgaactagtgttgataaaatacactaatgtctttcttaattttattttattaggagaaaaatcagaatattaaatttgcaaacttttgaacagcagtaatagctccttagacactcagtatctttcttccctatctttcaagcacatttaatttctttcccctggtatttgtttgctttgtgttttttcaatattttgtttgctaaagaacaataacaacaacaaagctggtccagccctgacacctacttttgctttttttctttctttcttttaatttgttgaactataggtttctttctgagatgtatttttcattcttccaataatgctctctttttcatttcaaaaccattaccactttcaatatgtaattaacatcctcattcatcagaaagctggtaagtccacacagcatttgtgcagtatcccttctgtgtaaaatgttaaggctttcagatgaaagaaaaaagaacttcctgcaaaagatcaaaagcatcatactaaataaaatgatgacaatatgtgccttgatttttctctcaatggaggttcaacattgacatttaagatgtaaaaaaaattactttgatggtttaattaagaataataagtcaaatatcacatgtatgtagttcttttggatgaccgaataccttaaaatgaactaaataactgaaataaagtgttaaaatgttaaaaacg

SEQ ID NO: 415061 - DNA, 129 bp, Homo sapiens
  misc_feature (71)..(71): n is a, c, g, or t
  misc_feature (125)..(125): n is a, c, g, or t
aacagtttgatgccacgcacattccagggcttagactggaaatgctgtcccttgcccctttgttaccttcngacagggatcagtccatagtgtagttggtgtcacaacagtcccgaagaagcctnccaa

SEQ ID NO: 415062 - DNA, 645 bp, Homo sapiens
tgagactctgtctcaaaaaaaaaaaaaaaaagaaagaaaaagaagcagtatgatgacagggatgacttcattagctgagaatcatttctatcagtttgccgaggaagaaggacactgcgttttcttattattgtctgatttagagagcatggaggtggggaggaatcatataaaatgatgatggcagtcatcatactgttgctgagcacttttttcctgacagaatggcacagtgcttctgtgctctaccaactagccatgaaatagagcatatctgtagaaatcatgcaagggagatggtgggcactaggactgcatagcaatcactgtttaggcaagaatgattaaaaagtagtcatttttggctgggcgcggtggctcacacctgtaatcccagcactttgggaggcaaggtgggtggatcacttgaggtcaggagtttgagaccagcctggtcaatatctccaaaccccatctctactaaaaatacaaaaattagctgagcgtggtggtagatgcttgtaatcccagctactcgggaggctgaggcaggagaatcgcttgaacccgggaggcagaggttgcagtgagccaagatcgcaccattgcactccagcctgggtgacaagagcaaaactctgtctc

SEQ ID NO: 415063 - DNA, 220 bp, Homo sapiens
tttcaacttgactcaaattttaagggatacatttactatgtaaagctagcatttaaattaaatatttaatttaaattaaatattctctacacttgtcccagctactcaggaggctgaggcaggaggattgcttgaacttgggaggcggaggttgcagtgagccgagatggcaccactgcgctgcagcctgggtgacagagtgagactccatctcaaaaaa

SEQ ID NO: 415064 - DNA, 300 bp, Homo sapiens
cccagcagaatcttcaactagaaattgcttttgtggttgatattgggaaggtacttctagattccaggctctttgtaattactgatgagcaaacacttacagccgcacccaaggtcaaataggcaaagcctttccaggatacttaaggataattcgcacatctgtattggctaatccattcatccaagaaaggacaggcacagagaaaggaaagagagaagtagggcagccaaattgctttcacaatacctcatgcctttagcttttctatctcaaggaatttccataggcacaagactt

SEQ ID NO: 415065 - DNA, 328 bp, Homo sapiens
tttgagacggagtctcgctctgtcgcccaggctggagtgcagtggcgggatctcggctcactgcaagctccgatgggcagcctcttaatagttccccatgcttcaacacttgcccaaccaccatctattttctatatagcagccacatcttatagacctggctcatagctgccttgtagaactcatctccttccagccgccttgctctgtctcaaacactctaggcatatttccttctcaaggcctctgtgcttgttccctctgcttgaaatgtgctttccccaaacagctgtatggcttttttcttcacttccttcaggcctcttct

SEQ ID NO: 415066 - DNA, 98 bp, Homo sapiens
gacctcagattatgcaaataaacattgaaggaagaataagataacactccttccatcaagtgtggggcctattttctctccgtttgtatctggcctga

SEQ ID NO: 415067 - DNA, 405 bp, Homo sapiens
tttttgtagagatgggtttcaccatgttggccaggctggtcttgaacacctgaccaagtccaaggtgaactcctgaccaggccaaggtgatccgcccacctcagcctcccaaaatgctgggattacaggcctgagccactgcgccaggccaatgtttttttacctaagggtttgggcagattccttaacctcttttgcctatctattcatagacacagaagacatacaagaggttcagaaattgctgtggatgaaaagcagcagttttatggcaagttatatcaaagtctgagaatatcaaaagacttatttaaaaggaaactttagaaagtgaatctgtttttaagaatagttcttggaatatttttgcttcaagtgatatatttaagttttcttatatttgtc

SEQ ID NO: 415068 - DNA, 3375 bp, Homo sapiens
  misc_feature (3311)..(3311): n is a, c, g, or t
ctaaaagaaggggagaatggatactgggggacaattagtagtctctgctacacacaggctgggaaatatcatgctctgaggctgaactgctccccgtggactttacttcctagagctatgctctagggccatattctccagtgctttgctgatttcagtggaaatgctgtatagggcagatgtcagcaggatctcccagatgctactttccagatcagtgatgcaaacacttctctgaatttggaagaccaaagccttccccaggatttttctgaattcctggggcttatgttcccagggctacatctgcttctgttgactcagctaaaacccctgctctctaggctgtgttctgagattgttcctaaacccttctctccttgttcctaaagccttctctcccggcatcaacccacaggagtgactcatctttttctcaaagccctcacctgcacatggataaaaggccctcgtgctctgcacagtagggctttactggagatctctgggtcacaggcaaaggtcacttaaaatcattgttaatccacttgttcccactggcaccagagaatgctggtgtcatcagtagagatcacacgcttatccccttgttgggcatttaatgcacttaaagggcttggtgatgttgggaaaacccaatggacctgccccagagtctgaaacacacacagggcagaaagagccagaaacgttcctggcatcagattcacttaagaaaccaaactcatggatgttaattctgggtccagcctgggctttacttggcaattacttttccttaatcttcagcgacaagagcctctttgttttactgtctccgactccagaaatgctcactgccagccccacatgacaagtgactttaatggtctttagttttggagatctactttattgaaacctatctgtgtgtaataatatgaaatagacaagaatgactttcagggtcaaatttcctctttttgacagtgatattttaaggactagaagcattttgaccagatgaatggagctttcagacgggatgatgagcatctcaaggcaggttggccatagttatcactatatcttccttattaatttgtattccatttatgcttcctgtttttaaccagtggtccattcggaatatgaatggatgactgtgaaactgagagtagagttcatttgaaactttacctgaccaggaggagtcagtccagaggtgtttctggcaagatggggcccactgctggttttattgtagggtggcaagggagctaggctcaggggcacgctactgcccggggccagggcaggcactaggggttccaggggctgggagcccctgtccctattgcagaggggactggaggaagagaagccttgttgcccccaccatgggacttctctgtcctgaggcctctcacacacattggtttacctttgaaacactgtacattgagagctctcctgagggtgagtgtagacttgaaccaagacaatgtttttgaggacaagggaactttaaggattttttctgtttttttgtttcgttttgttttttaattttgagaaagggtctcactctgtcacctaggctggagtgcagtggcacaatcttggctcactgcagccttgacttctctggctcaggtgatcttcccacctcagcctcccaagtagctgagactacaggtgcacaccaccatggccaggtgattttttgattttttatagagacgggatctcactatgttgcccaggctggtcttgaactcctgtgctcaagtgatcttcctgccttgccctcccaaagtcctgggattacaggcatgacacaccatgcctggcaattttggggtgtaaagtatcacaattaatattatctcaaagattcctgacaccaaaatggatctcaaaagtggttctattttcacattttctccctttctttagtttggaagcatattccctttaacacccccagaaaaagtaatttggcagggttgtatcctgaagtactaatttgttttctgtgtatcccctctctttctgtcctctcagcaagatttccagggctgtgggagtattttgctctccttcctcctgcagagaggcagaaagaaactcgtgggagagggaccaagactggatgcttgcttgcaagcctgtttttgttttttaaaattctgctcttgaaaactaaataaggctgaggccagtcttattttcagactgtttgccaacagcacaccaaaaagttggagtgacaatttctttcttggagagggaatggagtagcatggcacatctattcccaccaaggtcatgatcctggaaataaatagacctttgttgtctatgatgatttgatcaatatctgccttcattggattttcagctccttgaggatagtctgcttttgcttactgaaagttcatcagtacctagcacgtaagagccgctcgatgtatactcattcagtaagtgaatgaattctaggagagcactgggagcagattgtgtcttattgataggtctacttctagcatttgcagggcctaagctgagagtgctcatggagtctcagtatttaggaggtataaacaagctatacactgttaaataaaatactttctattctcctacctagatatgtttgctttcataattgcaaaacaaacatatttgcaaagtgatggcttttatgtgattgaaaattggtaaaatatacaactaaacttaattatcaccgcacttgaagaaagtcgatgggatggcaatgtttggatgagcattaaagacataaattcatgaattttatactttatacatttttaaaatcagactttaatttttacaattatttttctttctttaatttcattagaatcattaattatgctctcctgagcttttcatataatgtgtggtttattgatgatataaaagattaaaaagtacattgaattatacttcagtgtacaagaagtaaatatcttcatcaaaactctgtgttaaaaattgaaaaattaaatttttcatatgcattttcaaagttagttttctttgaaaatattcaaaattattaataataaaaagcgagatacaaataattaaagagctttaatatttaatctcaaaattctttaaatcaaaatgaaatgtctaaattcattttttgaaaatgtaataaaatctgtttttgttttgttttttgatatggggtctcactatgctgcccaggctggcctcaaactcctgggctcaagggatcatcctgcctcagccatctgagtagctggaantacaagcccgtgtcactgcacccagctcaaaaaaattaattaaatcttattaaatatattttat

SEQ ID NO: 415069 - DNA, 990 bp, Homo sapiens
cgcagaagtgcgggaacgcgccgtccctctgcgcaggcgcagtcggcggtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415070 - DNA, 1114 bp, Homo sapiens
  misc_feature (1001)..(1001): n is a, c, g, or t
  misc_feature (1003)..(1003): n is a, c, g, or t
  misc_feature (1005)..(1005): n is a, c, g, or t
  misc_feature (1009)..(1010): n is a, c, g, or t
  misc_feature (1017)..(1017): n is a, c, g, or t
  misc_feature (1019)..(1019): n is a, c, g, or t
  misc_feature (1029)..(1030): n is a, c, g, or t
  misc_feature (1032)..(1032): n is a, c, g, or t
  misc_feature (1043)..(1044): n is a, c, g, or t
  misc_feature (1048)..(1048): n is a, c, g, or t
  misc_feature (1063)..(1063): n is a, c, g, or t
  misc_feature (1068)..(1068): n is a, c, g, or t
  misc_feature (1073)..(1074): n is a, c, g, or t
  misc_feature (1076)..(1076): n is a, c, g, or t
  misc_feature (1078)..(1078): n is a, c, g, or t
  misc_feature (1081)..(1081): n is a, c, g, or t
  misc_feature (1091)..(1091): n is a, c, g, or t
  misc_feature (1093)..(1093): n is a, c, g, or t
  misc_feature (1097)..(1097): n is a, c, g, or t
ctcgagtccgggcattgtacaagcgcgtcttgcaatctgcaccggtgtgtctgcgccccaggtaccttcgaaagtcctcatagggtcgtaggcggtggtgcggtgggctgctgggatgcgtggtaggtggtggtgatcgggtgtgtgtgtggctgttgtgtgggtcttgggggtgtttgtgtggatggtgtggtaggttgtgtgggggtgtggttgtggtgggggttgggtgggcgtggagtgggtgggggggggttggggttagtgtggatggggagaggtgggggtcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaaaaaatggccttgttggctcagcggtggacntngnggcnnttccttnangagggtaatnntnacctgctcatnnctcntggctcggcgttcgntgggnagggnntnantcntaaggcggantnggtntccaaaatcagggatac

SEQ ID NO: 415071 - DNA, 799 bp, Homo sapiens
cccgcagtgatttttattattcttacccccccgcttgttaattttcggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415072 - DNA, 950 bp, Homo sapiens
  misc_feature (837)..(837): n is a, c, g, or t
  misc_feature (839)..(839): n is a, c, g, or t
  misc_feature (841)..(841): n is a, c, g, or t
  misc_feature (845)..(846): n is a, c, g, or t
  misc_feature (853)..(853): n is a, c, g, or t
  misc_feature (855)..(855): n is a, c, g, or t
  misc_feature (865)..(866): n is a, c, g, or t
  misc_feature (868)..(868): n is a, c, g, or t
  misc_feature (879)..(880): n is a, c, g, or t
  misc_feature (884)..(884): n is a, c, g, or t
  misc_feature (899)..(899): n is a, c, g, or t
  misc_feature (904)..(904): n is a, c, g, or t
  misc_feature (909)..(910): n is a, c, g, or t
  misc_feature (912)..(912): n is a, c, g, or t
  misc_feature (914)..(914): n is a, c, g, or t
  misc_feature (917)..(917): n is a, c, g, or t
  misc_feature (927)..(927): n is a, c, g, or t
  misc_feature (929)..(929): n is a, c, g, or t
  misc_feature (933)..(933): n is a, c, g, or t
cccgcagtgatttttattattcttacccccccgcttgttaattttcggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaaaaaatggccttgttggctcagcggtggacntngnggcnnttccttnangagggtaatnntnacctgctcatnnctcntggctcggcgttcgntgggnagggnntnantcntaaggcggantnggtntccaaaatcagggatac

SEQ ID NO: 415073 - DNA, 784 bp, Homo sapiens
  misc_feature (671)..(671): n is a, c, g, or t
  misc_feature (673)..(673): n is a, c, g, or t
  misc_feature (675)..(675): n is a, c, g, or t
  misc_feature (679)..(680): n is a, c, g, or t
  misc_feature (687)..(687): n is a, c, g, or t
  misc_feature (689)..(689): n is a, c, g, or t
  misc_feature (699)..(700): n is a, c, g, or t
  misc_feature (702)..(702): n is a, c, g, or t
  misc_feature (713)..(714): n is a, c, g, or t
  misc_feature (718)..(718): n is a, c, g, or t
  misc_feature (733)..(733): n is a, c, g, or t
  misc_feature (738)..(738): n is a, c, g, or t
  misc_feature (743)..(744): n is a, c, g, or t
  misc_feature (746)..(746): n is a, c, g, or t
  misc_feature (748)..(748): n is a, c, g, or t
  misc_feature (751)..(751): n is a, c, g, or t
  misc_feature (761)..(761): n is a, c, g, or t
  misc_feature (763)..(763): n is a, c, g, or t
  misc_feature (767)..(767): n is a, c, g, or t
ttatagggttttaagtgcctaaagtcagggagagaaaaggagacagtatttaaggaatttaagatcttgaagtggaaaaggcctagaagagccataactgctgagtcttggaaagaaaatgaaacagagtgtctgcatgcagtttccttaaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagaaaaaaaaaaaatggccttgttggctcagcggtggacntngnggcnnttccttnangagggtaatnntnacctgctcatnnctcntggctcggcgttcgntgggnagggnntnantcntaaggcggantnggtntccaaaatcagggatac

SEQ ID NO: 415074 - DNA, 1070 bp, Homo sapiens
cgcagaagtgcgggaacgcgccgtccctctgcgcaggcgcagtcggcggtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggagggtatgtccagaaatcttgatgcatgtatctgaaaagaaaatttctgtttcatgtgaagaattccgatttggtactttcagtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415075 - DNA, 904 bp, Homo sapiens
ttatagggttttaagtgcctaaagtcagggagagaaaaggagacagtatttaaggaatttaagatcttgaagtggaaaaggcctagaagagccataactgctgagtcttggaaagaaaatgaaacagagtgtctgcatgcagtttccttaaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415076 - DNA, 926 bp, Homo sapiens
  misc_feature (28)..(29): n is a, c, g, or t
tatttaagttaaataatgagttagtatnnagcttaaggccaatggccacccttcgtctgggaggtgaggagcgcctctgcccggctgccctatctgggaagtgaggagcgcctctgcccggccgtcccatctgggaggtgaggagtgtctctgcccggccgccccgtctgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415077 - DNA, 812 bp, Homo sapiens
gaattaggaatgagatgggtatggaaagagaaaagagaagagacaagtttggacgttaccgtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415078 - DNA, 955 bp, Homo sapiens
cgcagaagtgcgggaacgcgccgtccctctgcgcaggcgcagtcggcggtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagtcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415079 - DNA, 1011 bp, Homo sapiens
  misc_feature (898)..(898): n is a, c, g, or t
  misc_feature (900)..(900): n is a, c, g, or t
  misc_feature (902)..(902): n is a, c, g, or t
  misc_feature (906)..(907): n is a, c, g, or t
  misc_feature (914)..(914): n is a, c, g, or t
  misc_feature (916)..(916): n is a, c, g, or t
  misc_feature (926)..(927): n is a, c, g, or t
  misc_feature (929)..(929): n is a, c, g, or t
  misc_feature (940)..(941): n is a, c, g, or t
  misc_feature (945)..(945): n is a, c, g, or t
  misc_feature (960)..(960): n is a, c, g, or t
  misc_feature (965)..(965): n is a, c, g, or t
  misc_feature (970)..(971): n is a, c, g, or t
  misc_feature (973)..(973): n is a, c, g, or t
  misc_feature (975)..(975): n is a, c, g, or t
  misc_feature (978)..(978): n is a, c, g, or t
  misc_feature (988)..(988): n is a, c, g, or t
  misc_feature (990)..(990): n is a, c, g, or t
  misc_feature (994)..(994): n is a, c, g, or t
cgcagaagtgcgggaacgcgccgtccctctgcgcaggcgcagtcggcggtcggcgtggggcgctatgccggggcggcacgtttctcgagtccgggcattgtacaagcgcgtcttgcagctgcaccgtgttctgcccccggacctcaaatccctgggcgaccagtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaaaaaatggccttgttggctcagcggtggacntngnggcnnttccttnangagggtaatnntnacctgctcatnnctcntggctcggcgttcgntgggnagggnntnantcntaaggcggantnggtntccaaaatcagggatac

SEQ ID NO: 415080 - DNA, 1141 bp, Homo sapiens
  misc_feature (1028)..(1028): n is a, c, g, or t
  misc_feature (1030)..(1030): n is a, c, g, or t
  misc_feature (1032)..(1032): n is a, c, g, or t
  misc_feature (1036)..(1037): n is a, c, g, or t
  misc_feature (1044)..(1044): n is a, c, g, or t
  misc_feature (1046)..(1046): n is a, c, g, or t
  misc_feature (1056)..(1057): n is a, c, g, or t
  misc_feature (1059)..(1059): n is a, c, g, or t
  misc_feature (1070)..(1071): n is a, c, g, or t
  misc_feature (1075)..(1075): n is a, c, g, or t
  misc_feature (1090)..(1090): n is a, c, g, or t
  misc_feature (1095)..(1095): n is a, c, g, or t
  misc_feature (1100)..(1101): n is a, c, g, or t
  misc_feature (1103)..(1103): n is a, c, g, or t
  misc_feature (1105)..(1105): n is a, c, g, or t
  misc_feature (1108)..(1108): n is a, c, g, or t
  misc_feature (1118)..(1118): n is a, c, g, or t
  misc_feature (1120)..(1120): n is a, c, g, or t
  misc_feature (1124)..(1124): n is a, c, g, or t
cgcagaagtgcgggaacgcgccgtccctctgcgcaggcgcagtcggcggtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaaaaaatggccttgttggctcagcggtggacntngnggcnnttccttnangagggtaatnntnacctgctcatnnctcntggctcggcgttcgntgggnagggnntnantcntaaggcggantnggtntccaaaatcagggatac

SEQ ID NO: 415081 - DNA, 884 bp, Homo sapiens
  misc_feature (844)..(844): n is a, c, g, or t
cgcagaagtgcgggaacgcgccgtccctctgcgcaggcgcagtcggcggtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtccctcccaagtgttattttaatactgtctctgacatttcactttggttaaaaacacaaantcgaagggtcccgagagggttcaagaggggggaagaactt

SEQ ID NO: 415082 - DNA, 786 bp, Homo sapiens
agatctctacctaaatggctgtcaggaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415083 - DNA, 963 bp, Homo sapiens
ctcgagtccgggcattgtacaagcgcgtcttgcaatctgcaccggtgtgtctgcgccccaggtaccttcgaaagtcctcatagggtcgtaggcggtggtgcggtgggctgctgggatgcgtggtaggtggtggtgatcgggtgtgtgtgtggctgttgtgtgggtcttgggggtgtttgtgtggatggtgtggtaggttgtgtgggggtgtggttgtggtgggggttgggtgggcgtggagtgggtgggggggggttggggttagtgtggatggggagaggtgggggtcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 415084 - DNA, 2188 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacat

SEQ ID NO: 415085 - DNA, 738 bp, Homo sapiens
ctacattatataaatgttttataggctcatctttcaactttcattttcataaagaaaaacaaccaaaatgggagcttcttaattcactattttatagttaaatccgaattacctagtactagcttagaattcagacaagtgcaggcttggaaaatatgtgtctgaatggtaccaggaacttgctatttttgactcaaactattgagaatatgtgtttatgatgctaattactcattttaatgtgtagattctcgtctttggggtattaggatgaaggaaaagaagaaagaagcagaaaggtgactgctctatgtaacagaaataagacctaatgtatgagttaagcataaagtcagtctactttatttgcagtcttaattgtaactgtcataattctttgcattggtacatttttaattattcttcctcttcctgttccttttttctgtccttttcagttatcctcaataaccactaggaacctctgcttctttctcctgaatttcttctttctcctacattgttccatatattaatcagttcagttagtgttgctcactttagatagtaaaagtatacacagaacagcaaaatgtcaggatatgtgaaatataaattgctttttgacagttttgccttatatccttgtataatgtgagacatcatatcctgaattctctgttttgttttgttgttttgaaacagagtgatactccgtctcaaaaaaaaggaaaaaaa

SEQ ID NO: 415086 - DNA, 4025 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatcaatgttgaactgctttttctttcgttctgttagacatttgagaccatttggggaaaaaataattatagtttgggcaaagtaatttttataaataatttaaaattatttaatgacttctctattctttcctatcagactctactgttaggaattaaaaatgaagcagcaaagatatcctgacctgctccattcttgctaatgttccatctacaacatttctaattaggcagaaattcatgtacttcagctaagtggtaatgaaaagtgattcatttgctgaataagagatgagagtgagtgtaattagctgactgcggtttttaatctttcaacaattcaatgtgtttaacttagtttcaaagaataggagctttcaagtgttgttacttcagagcaatcaagccagcctctggtggccgcatagtagaatatggtccctgatatttaaaaccgatcatcttaagtaaattttttctttaagaagtatatcttcactttctcaaatatgtatggttcttagacgaagtaaatgtttatctgaacctt

SEQ ID NO: 415087 - DNA, 3372 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415088 - DNA, 3372 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415089 - DNA, 3452 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagattcttctgtctgttttcgtctggtagatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415090 - DNA, 3241 bp, Homo sapiens
ctacattatataaatgttttataggctcatctttcaactttcattttcataaagaaaaacaaccaaaatgggagcttcttaattcactattttatagttaaatccgaattacctagtactagcttagaattcagacaagtgcaggcttggaaaatatgtgtctgaatggtaccaggaacttgctatttttgactcaaactattgagaatatgtgtttatgatgctaattactcattttaatgtgtagattctcgtctttggggtattaggatgaaggaaaagaagaaagaagcagaaaggtgactgctctatgtaacagaaataagacctaatgtatgagttaagcataaagtcagtctactttatttgcagtcttaattgtaactgtcataattctttgcattggtacatttttaattattcttcctcttcctgttccttttttctgtccttttcagttatcctcaataaccactaggaacctctgcttctttctcctgaatttcttctttctcctacattgttccatatattaatcagttcagttagtgttgctcactttagatagtaaaagtatacacagaacagcaaaatgtcaggatatgtgaaatataaattgctttttgacagttttgccttatatccttgtataatgtgagacatcatatcctgaattctctgttttgttttgttgttttgaaacagagtctcgctctgtcgcccaggctggagtgcagtggcacgatctctgctcactgcagcctccacctccttggttcaaagtgattctcctgccttagcctcccaagtagctgggactacaggcatgtgccaccatgcctggctgattttgtatttttagtagagatggggtttcatcctgttggccagtctggtcttgaacttctgacctcaggtgatctgcccacctcagcctcccaaagtgctgggattacaggcataagtcactgcgcctggcctctgaattctgttttgaaagaataaatgtccacttgtgtatctccttaaagctgtactaacctaaaatcggtagttcccctgggcatttgccagggatggtggcttctagactttgagtgatgggagaataattgttagtgtaggtaagttgttggttttatccacctcaaacctgattgggacttcagaggaacctctttgggaagctaatgattcagggtattgaagacattagcatagaacattagtggttctttttgtttcagaagttcattgttgtgattaaattgccatctgataatttttatagaacagatgcttaatttttagagcatttttctattttccagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415091 - DNA, 3187 bp, Homo sapiens
ctacattatataaatgttttataggctcatctttcaactttcattttcataaagaaaaacaaccaaaatgggagcttcttaattcactattttatagttaaatccgaattacctagtactagcttagaattcagacaagtgcaggcttggaaaatatgtgtctgaatggtaccaggaacttgctatttttgactcaaactattgagaatatgtgtttatgatgctaattactcattttaatgtgtagattctcgtctttggggtattaggatgaaggaaaagaagaaagaagcagaaaggtgactgctctatgtaacagaaataagacctaatgtatgagttaagcataaagtcagtctactttatttgcagtcttaattgtaactgtcataattctttgcattggtacatttttaattattcttcctcttcctgttccttttttctgtccttttcagttatcctcaataaccactaggaacctctgcttctttctcctgaatttcttctttctcctacattgttccatatattaatcagttcagttagtgttgctcactttagatagtaaaagtatacacagaacagcaaaatgtcaggatatgtgaaatataaattgctttttgacagttttgccttatatccttgtataatgtgagacatcatatcctgaattctctgttttgttttgttgttttgaaacagagtctcgctctgtcgcccaggctggagtgcagtggcacgatctctgctcactgcagcctccacctccttggttcaaagtgattctcctgccttagcctcccaagtagctgggactacaggcatgtgccaccatgcctggctgattttgtatttttagtagagatggggtttcatcctgttggccagtctggtcttgaacttctgacctcaggtgatctgcccacctcagcctcccaaagtgctgggattacaggcataagtcactgcgcctggcctctgaattctgttttgaaagaataaatgtccacttgtgtatctccttaaagctgtactaacctaaaatcggtagttcccctgggcatttgccagggatggtggcttctagactttgagtgatgggagaataattgttagtgtaggtaagttgttggttttatccacctcaaacctgattgggacttcagaggaacctctttgggaagctaatgattcagggtattgaagacattagcatagaacattagtggttctttttgtttcagaagttcattgttgtgattaaattgccatctgataatttttatagaacagatgcttaatttttagagcatttttctattttccagcctttgcaaaatgttagcacagtgctgcagaagcctaatcctctctataatcagaatacagatatggtccagaaatcagtcagcttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415092 - DNA, 3372 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaacctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415093 - DNA, 2242 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacat

SEQ ID NO: 415094 - DNA, 1371 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagccaggtccaattaaaatggttttaaccaaaaaccctaaagttataattaaaactcaggggcttacaacaagtattttgggaacctttttatcctgtttatgggccccgccatcaacaagggggttccctgtttttttggggggttggctgatttgggcaaagggtgaaaaaagagttttcctttccaggacaacaacaaaggggaagggaattttgggacggaggggctttaaaaaacccaataggccttggttttccagggaagattttggagggcccaaaccccggg

SEQ ID NO: 415095 - DNA, 600 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgtgcatatgatagtgtcacggtatatatatatggcagagggtgttagggatttgtg

SEQ ID NO: 415096 - DNA, 256 bp, Homo sapiens
ccttccaaaccccagcagccatcactgaatacaatgattcagcaacagagtaagttaccttaagacgtcccacttctttgtgtacttgcagtcttttgccttaatgccaggactacttcaaactataaataaaaatatatcacataaattgtaacagttaaccaaatgcctgttcacttaagatattttcacataatatttactgggtattcctcctggcacattgaattactttatattctattcttgtcctgat

SEQ ID NO: 415097 - DNA, 3426 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415098 - DNA, 3377 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415099 - DNA, 3351 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415100 - DNA, 2611 bp, Homo sapiens
  misc_feature (23)..(23): n is a, c, g, or t
  misc_feature (25)..(25): n is a, c, g, or t
  misc_feature (27)..(27): n is a, c, g, or t
ttaccgaccggaagcagactgcncnanacataaacgcagactacattaagaagtgataagcacagtggagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415101 - DNA, 1568 bp, Homo sapiens
attgtgcctgtcaagcccatcccagcagcggacatccctatgttcatgttcatgcccatcatgctctggttcatcatcggagtatttccaagaggggccattcccatggtgccagtcatcacattgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatca

SEQ ID NO: 415102 - DNA, 1658 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacaggtaagttgtctggttcccttggaatttgttatttataatctttgagatgctctaactcattgaatgatagattagtataaaacagaaa

SEQ ID NO: 415103 - DNA, 2057 bp, Homo sapiens
cgccgcggccggcgcgcgctcccgggaggcggcagcggctgcagcgttggtagcatcagcatcagcatcagcggcagcggcagcggcctcgggcggggccggccggacggacaggcggacagaaggcgccagggcgcgcgtcccgcccgggccggccatggagggcgcctccttcggcgcgggccgcgcaggggccgccctggaccccgtgagctttgcgcggcggccccagaccctgctccgggtcgcgtcctgggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggactctggtccttcctgtggttcgtgggcttctgcttcctcaccaatcagtggcagcgcacggcgccagggccggccacgacgcaggcgggggacgcggcgcgggccgccatcgccttcagcttcttctccatcctcagctgggtggcgctcaccgtgaaggccctgcagcggttccgcctgggcaccgacatgtcactcttcgccaccgaacagctgagcaccggggcgagccaggcctaccccggctatccggtgggcagcggcgtggagggcaccgagacctaccagagcccgcccttcaccgagaccctggacaccagccccaaagggtaccaggtgcccgcctactagcggctggcaggcacagaccagggctccaaggccaccccaccaacgcaggccccagggtctccgggacctcccttgggtccttccagctcagtgccgcggacagagtaggtggccgctttgcgccatccggggccaagagggggtggacccgcgtgtctgggctgcccctgccaagttcccccagtccctcagcacctggccccaggactgaggtcctgagaaggggatagcactgcccaggacgtgtgtccctagcctggaatggactggcctggggaaggctttcccctcttgggccacacctgctcactctggggttgggggtccagctgccctctacgatcaggtgcaggggctgcccaggacaaagcgggggcaggggaaagacaccaccctcgccccaagactggggatcctggccactgttcccatcccatgtccctgtgggtagtgactgtctcgtttctgtcatggtggtgcgtcccgtccggagccactctccactttctctcacaggctgctagaacagcccagccctgtcagtgttgtgatcatggtccagtcttcgggtttcacctcctagtactccacaagctgctcctctctctgtggccccggcccctgcccaggtgtgggtggttctggccaggaaggcacaaggtagctgtgggccaagacaccagccctgtcctagcccttcagtaagaccttgccaggagaggagaaggatgcctgggtgccaggcaagacaagcccctcagcaggagagaggcccagaggctccagctggccaccgtgccccacaagatggcccctgtgtggttccctttaccttggcttcctggcccagtccctgcctctccacctgcaccctgcttcctggcccagtcccaggttggagtccctctgcatagctgactactcatgcattgctcaaagctggcttttcacattaagtcaacaccaaacgtggttgccacatttcatcagacagacacctccctctggagatgcagttgagtgacaaccttgttacattgtagcctagaccaattctgtgtggatatttaagtgaacatgtttacaatttttgtatatatcactctctccctctcctgaaagaccagagattgtgtattttcagtgtcccatgttccgactgcaccttctttacaataaagactgtaactgagctgactgtgaaatggac

SEQ ID NO: 415104 - DNA, 1741 bp, Homo sapiens
ggtctggcgctcccgggtgggcggggtcagcgcaggagagggaggcgggacctcgcgccacgcggcgagcccaggcgaggcgccccaagcctcgggcccaccgacctttcctcctccgggcgaggccgccgtgggccaccgcgtggagcgtcgccctgacgcgccgcactgttcgcaggactctggtccttcctgtggttcgtgggcttctgcttcctcaccaatcagtggcagcgcacggcgccagggccggccacgacgcaggcgggggacgcggcgcgggccgccatcgccttcagcttcttctccatcctcagctgggtggcgctcaccgtgaaggccctgcagcggttccgcctgggcaccgacatgtcactcttcgccaccgaacagctgagcaccggggcgagccaggcctaccccggctatccggtgggcagcggcgtggagggcaccgagacctaccagagcccgcccttcaccgagaccctggacaccagccccaaagggtaccaggtgcccgcctactagcggctggcaggcacagaccagggctccaaggccaccccaccaacgcaggccccagggtctccgggacctcccttgggtccttccagctcagtgccgcggacagagtaggtggccgctttgcgccatccggggccaagagggggtggacccgcgtgtctgggctgcccctgccaagttcccccagtccctcagcacctggccccaggactgaggtcctgagaaggggatagcactgcccaggacgtgtgtccctagcctggaatggactggcctggggaaggctttcccctcttgggccacacctgctcactctggggttgggggtccagctgccctctacgatcaggtgcaggggctgcccaggacaaagcgggggcaggggaaagacaccaccctcgccccaagactggggatcctggccactgttcccatcccatgtccctgtgggtagtgactgtctcgtttctgtcatggtggtgcgtcccgtccggagccactctccactttctctcacaggctgctagaacagcccagccctgtcagtgttgtgatcatggtccagtcttcgggtttcacctcctagtactccacaagctgctcctctctctgtggccccggcccctgcccaggtgtgggtggttctggccaggaaggcacaaggtagctgtgggccaagacaccagccctgtcctagcccttcagtaagaccttgccaggagaggagaaggatgcctgggtgccaggcaagacaagcccctcagcaggagagaggcccagaggctccagctggccaccgtgccccacaagatggcccctgtgtggttccctttaccttggcttcctggcccagtccctgcctctccacctgcaccctgcttcctggcccagtcccaggttggagtccctctgcatagctgactactcatgcattgctcaaagctggcttttcacattaagtcaacaccaaacgtggttgccacatttcatcagacagacacctccctctggagatgcagttgagtgacaaccttgttacattgtagcctagaccaattctgtgtggatatttaagtgaacatgtttacaatttttgtatatatcactctctccctctcctgaaagaccagagattgtgtattttcagtgtcccatgttccgactgcaccttctttacaataaagactgtaactgagctgactgtgaaatggac

SEQ ID NO: 415105 - DNA, 258 bp, Homo sapiens
tgtagtaggctggcagttaaaggtgccagatgtgagccaggctgctgggtttgaatcctggagctgcctcatagcagcagtaggactttgggtaacttacataggtgctgtatgcctcagtgacctcatctgtaatatagagatgataagagtacctgtctcattggtctactgagttgtccggattaactcattaaatgagttaaaactcatgaagcccttggaactgtgactgacacatagtaagtactcaataaa

SEQ ID NO: 415106 - DNA, 814 bp, Homo sapiens
ttatttcaggaaggatagtgaccctttccttgaactgttagaagggcatttattaggctaaaacgtcattaacaaaatgcattgcatgttgaaaccagcctcttgaaccataagcacttagcgactttgctctgccctgtactgtgctgcttctgctgtcatcctgtgtgcctacagaagcctggtcttccgtccatgcagaaatgcttatgtcctcctgttgtttagatgactcctattgttcaggtgtactctgagaagagaatcacgtttttctgttttgctaaggagaaaaccttgctgcttgtctctcctcccaccctccaccatccaaaattaaccagtgagctggatattacctggatattgccaggaggtgggcattaagacagtattctttaaaagtgaaaatcttgtgaggcaaactgctaaattcacatttttgtttttttttttttaccatcttccctaggaatattcctagaaagcatctgcttaattttgctgctaacagctaaccttatcccacgttgagggtggtattaaaactgttcacacagagtgagcctgggtcagtcaaaaacagaatttgggcatttgagtgataacagacaacctaaggacaatgagcactttgcagatctctacaattaaaagttgcctctttgaggcaggaggggagaagcacagtccctgccaggttgcctgaactaaagatgccatggagcaggagtgtcttggtgcattgttccccgcttaggagtacctttaaaaagggggtgaaataaatttggcttaataattgtaaaaaaac

SEQ ID NO: 415107 - DNA, 623 bp, Homo sapiens
  misc_feature (618)..(618): n is a, c, g, or t
  misc_feature (621)..(622): n is a, c, g, or t
aatctcagtatttttataaattgtaaagttattttccgtatctcttggacataatggtatttttgtgactgtgatattttgtcattttattttcttctctcacagcgtcagtggaggtcagcaggaggtccctgcaggcttgcactgccctgctggttatcactgctggtgactcatgcagccagcctgctgatgccctgagctggcctgttcagcttggtgtccagagggctctgctgtgggcccggggggagggaaccacgcaccttcctctgtggaactgtggctgctttcccccttcctcatcctgttcttcatctgccccagcctgtgaagggaactcctcgtgcctgggcaggcttatgggtgccgggaggctggggagctggctcacgctctgagtgggcttccctggccagtcctgtgccccatcaccagcctcgctctgtggtctttgccctggtgcactgggcggtaccacttcaccacgtctttcagtggtccttccgtgtgttccaaagcttctggatttcaaatgttgctgtgctcacagaaacctgatggtttacacaccaagcaataccaccaccaccaccgccaccaccacaacaacaaaanaanna

SEQ ID NO: 415108 - DNA, 183 bp, Homo sapiens
gttttactcttgtgaagatagcactttaatcctaaatgagcatgtaacgtgtgacagatcctatatcagttttaataattgaagcagatagtaataactagattattgacatttttgagtcatgtgttcagctattgcttcaaacttgctcaaattatacttggaattttatagtgttttatt

SEQ ID NO: 415109 - DNA, 2748 bp, Homo sapiens
ggaggaagctggcttcctggagccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgaaaaattcctt

SEQ ID NO: 415110 - DNA, 466 bp, Homo sapiens
ggaggaagctggcttcctggagccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctcctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgaaaaattcctt

SEQ ID NO: 415111 - DNA, 3925 bp, Homo sapiens
ggaggaagctggcttcctggagccttctcagccctcaaagacagaccgacagacagacagacagctggcaagaggcagcctgggggccacagctgcttcagtaagtatctgaaggggggactgggagtcctgtggccccggggggtgcgaactccggggatataagagggcatctctaggagggagtgcgggagggcgagtggggcgccacagtgcctggctggggtatgggtgctcacagacctgatgtccccaagacgggggtgagcagggaagccacagggagctacaaggagagcagaggctgaagggaccttttctgctaccagagaccctcgctctaccactcacacctgtgccaggcccattctgtcccctcacctccgtccctgctgccttggtgattcaacacccccgccacctcgcccactgtgaccctggctctgggagatagggactgcccccaagaggagatggtcccaccacctccatgccccctgtcttgcccccagctgtcgcctcaccatgcgctgtcgttcaagggcttggtgaggccatttcctgtgacggttacagaggcgggagacggggggatgggcaggaggaggaaggaaacacctccagcctacctccctggacagagaccccagaagccagaaacagacctgggagtggaacagcagcagttaggagaggaccctgctggggtccaggagcccgcctgcctggctgcccaaccagctccaacactgctggaggcctccattctctgttcaggggaaggcccactggttagctcagagatggcttctgcgtgctttctcccttccgtcctagagaacacatattttctgtttcctcccttgccttctcccacttggacctgctcagagccctgtgtactctggtgtgtggcctctctcccctctctcttttcctccttctggattctttcctatcttcatccacaatctctaccctttatcttgccgttactctaccccgagactgccttctgccctgggtcccaccaaatagatcctgtccttcccttagtgaaaatgaggccacctcttggggaacagaagacgccccagtgaaaacagagtgcaaacctggcctggcatgggagcctccttctggccaatcaggcaggccagagaacagcagcggagggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgaaaaattcctt

SEQ ID NO: 415112 - DNA, 2477 bp, Homo sapiens
ggaggaagctggcttcctggagccttctcagccctcaaagacagaccgacagacagacagacagctggcaagaggcagcctgggggccacagctgcttcaaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgaaaaattcctt

SEQ ID NO: 415113 - DNA, 2172 bp, Homo sapiens
gagagggcaaggagaaatgtgtccactcggagctgagtgagcatgacaatgagggacacttcctcttgccacaccatctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgaaaaattcctt

SEQ ID NO: 415114 - DNA, 2058 bp, Homo sapiens
ggaggaagctggcttcctggagccttctcagccctcaaagacagaccgacagacagacagacagctggcaagaggcagcctgggggccacagctgcttcagtaagtatctgaaggggggactgggagtcctgtggccccggggggtgcgaactccggggatataagagggcatctctaggagggagtgcgggagggcgagtggggcgccacagtgcctggctggggtatgggtgctcacagacctgatgtccccaagacgggggtgagcagggaagccacagggagctacaaggagagcagaggctgaagggaccttttctgctaccagagaccctcgctctaccactcacacctgtgccaggcccattctgtcccctcacctccgtccctgctgccttggtgattcaacacccccgccacctcgcccactgtgaccctggctctgggagatagggactgcccccaagaggagatggtcccaccacctccatgccccctgtcttgcccccagctgtcgcctcaccatgcgctgtcgttcaagggcttggtgaggccatttcctgtgacggttacagaggcgggagacggggggatgggcaggaggaggaaggaaacacctccagcctacctccctggacagagaccccagaagccagaaacagacctgggagtggaacagcagcagttaggagaggaccctgctggggtccaggagcccgcctgcctggctgcccaaccagctccaacactgctggaggcctccattctctgttcaggggaaggcccactggttagctcagagatggcttctgcgtgctttctcccttccgtcctagagaacacatattttctgtttcctcccttgccttctcccacttggacctgctcagagccctgtgtactctggtgtgtggcctctctcccctctctcttttcctccttctggattctttcctatcttcatccacaatctctaccctttatcttgccgttactctaccccgagactgccttctgccctgggtcccaccaaatagatcctgtccttcccttagtgaaaatgaggccacctcttggggaacagaagacgccccagtgaaaacagagtgcaaacctggcctggcatgggagcctccttctggccaatcaggcaggccagagaacagcagcggagggccctgtctttcaggcagacctcatggctgagtgagcctcccctgggcccagcaccccacctcagcatggtccaagcccatggggggcgctccagagcacagccgttgaccttgtctttgggggcagccatgacccagcctcgagatcttccctgggggaggggtcttccgagccctgagcccccattccgctcctcccttccttccatctgcccctccagctctgacagcagggtccagagggccctcagttgttgactccaatttggaaaggaaaccagtagtgctcatttgcatgtcttttgcatgtctggagcacagagtttcatatcaaccatgagcctgctccctaaattccaggcaaggcccacagccttcttggtgctggatgcatgtcggagccacagggcctggctgggagtgggaagaggcaggcagctggaaggagcagttgagttcaaggctgccctgttctggctgacaaagggagagggctgagccaggcatggtagctcatgcccaaaatcccagcactttgggaggctgaggtgagaggatctcctgagtccaggaattagagaccggcctaggcaatatagtgagacctcctctctctcaaaaaaaaaaaaaaaaagagggcacacagcaggggcccaaaccctaaatttactgggctaccaggttaaaggaaagataaagagcggccccctcagaggtgccttataacagtaatacttgtaagaaaagcaaatatggtcaggcacagtggctcatgcctataatcccagcactttgggaagccaaggcagaaggatcacttgagcccaggagttcaaaaccagcctgagcaacagaacaagacactgtctctccaaaaaaaaa

SEQ ID NO: 415115 - DNA, 236 bp, Homo sapiens
aaaaaaaaaaaaaaaaaaaaaaaagtgaaaagatgaatataggcaaaggagttggcatgttctttgagaaagtcaggactttcccagtaggaccacagggatgtttgactggagccattcagccagcaccctgaccctccttcactcatggtctgtgtgtttctccttgcagaggggggatgatccagacggcagagcagtaccagttcctgcaccacactttggccctgtatgca

SEQ ID NO: 415116 - DNA, 2835 bp, Homo sapiens
ggaggaagctggcttcctggagccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgaaaaattcctt

SEQ ID NO: 415117 - DNA, 744 bp, Homo sapiens
  misc_feature (59)..(60): n is a, c, g, or t
  misc_feature (160)..(160): n is a, c, g, or t
  misc_feature (174)..(174): n is a, c, g, or t
  misc_feature (176)..(176): n is a, c, g, or t
  misc_feature (725)..(725): n is a, c, g, or t
gggggtttccacagagagctggtatcaaggcagctgtcagggcggcgtgcctggtgatnnggcatcttaccttcatccccatctcagaatggcagccagtctcagattcaaggaggaggaatcctgaggtgtggcgttcagtcctgaggtagacctgagntcccctggaaattntnttgatgctgagatggatgaggggtgctcatcagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccattcttgcatctggcctgtgcttgggcaggacctcgggtgaaggatgatcttggaatcacccttttgtcagccccaggaaggantggctggagtggcttctag

SEQ ID NO: 415118 - DNA, 2782 bp, Homo sapiens
ggaggaagctggcttcctggagccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgaaaaattcctt

SEQ ID NO: 415119 - DNA, 2104 bp, Homo sapiens
ggaggaagctggcttcctggagccttctcagccctcaaagacagaccgacagacagacagacagctggcaagaggcagcctgggggccacagctgcttcagtaagtatctgaaggggggactgggagtcctgtggccccggggggtgcgaactccggggatataagagggcatctctaggagggagtgcgggagggcgagtggggcgccacagtgcctggctggggtatgggtgctcacagacctgatgtccccaagacgggggtgagcagggaagccacagggagctacaaggagagcagaggctgaagggaccttttctgctaccagagaccctcgctctaccactcacacctgtgccaggcccattctgtcccctcacctccgtccctgctgccttggtgattcaacacccccgccacctcgcccactgtgaccctggctctgggagatagggactgcccccaagaggagatggtcccaccacctccatgccccctgtcttgcccccagctgtcgcctcaccatgcgctgtcgttcaagggcttggtgaggccatttcctgtgacggttacagaggcgggagacggggggatgggcaggaggaggaaggaaacacctccagcctacctccctggacagagaccccagaagccagaaacagacctgggagtggaacagcagcagttaggagaggaccctgctggggtccaggagcccgcctgcctggctgcccaaccagctccaacactgctggaggcctccattctctgttcaggggaaggcccactggttagctcagagatggcttctgcgtgctttctcccttccgtcctagagaacacatattttctgtttcctcccttgccttctcccacttggacctgctcagagccctgtgtactctggtgtgtggcctctctcccctctctcttttcctccttctggattctttcctatcttcatccacaatctctaccctttatcttgccgttactctaccccgagactgccttctgccctgggtcccaccaaatagatcctgtccttcccttagtgaaaatgaggccacctcttggggaacagaagacgccccagtgaaaacagagtgcaaacctggcctggcatgggagcctccttctggccaatcaggcaggccagagaacagcagcggagggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggagatcttccctgggggaggggtcttccgagccctgagcccccattccgctcctcccttccttccatctgcccctccagctctgacagcagggtccagagggccctcagttgttgactccaatttggaaaggaaaccagtagtgctcatttgcatgtcttttgcatgtctggagcacagagtttcatatcaaccatgagcctgctccctaaattccaggcaaggcccacagccttcttggtgctggatgcatgtcggagccacagggcctggctgggagtgggaagaggcaggcagctggaaggagcagttgagttcaaggctgccctgttctggctgacaaagggagagggctgagccaggcatggtagctcatgcccaaaatcccagcactttgggaggctgaggtgagaggatctcctgagtccaggaattagagaccggcctaggcaatatagtgagacctcctctctctcaaaaaaaaaaaaaaaaagagggcacacagcaggggcccaaaccctaaatttactgggctaccaggttaaaggaaagataaagagcggccccctcagaggtgccttataacagtaatacttgtaagaaaagcaaatatggtcaggcacagtggctcatgcctataatcccagcactttgggaagccaaggcagaaggatcacttgagcccaggagttcaaaaccagcctgagcaacagaacaagacactgtctctccaaaaaaaaa

SEQ ID NO: 415120 - DNA, 1004 bp, Homo sapiens
atggcgcgatctcggctcaccgcaacctccgcctccaaggtttaagcgattctcctgcctcagcctcccgactagctgggattacaggcattcaccaccaagcccgtctaattttatatttttagtagagacgggatttccccatgttggtcaggttggtctcgagctcccgacctcaggtgatcgcccgcctcgacctcccaaagtgctgggattacaggcgtgaaccaccgtgcccggccttggccgcatgtgttttgaattttgctgcccggaattcactgcgaggactgggatcacccgtcaccccgccctggtctacggaaaatgaaatgtgtttactgatatagaaacggaataacggcgctgtgggctggggagggccgagctgccttcaggcttctggtctccagctgcagggcactcacacctgcccgttatgaaaatgcagacccgcagggcaggaattccgagtccgggctggagcgcgatctggaatccggctttcttgaaacagcaccgcggaggattcggatccgggtgagtaggaaactgcgcctcagcccctcccacgggccgcccacgtattccaggatccgaaaacgcttcctgctgctccgtcaccccaggaaggcagcgtccgcctctgggcggttctgatggaaaccggctgcgccgcccgcaggaaaacccacaactaaggggccaggaaaaagcctcttagggtcccgccacttcagtgaggatcctaatttacacccttagtttggcctccatgaaagactggagtgaccttcactgaaatgatacaaggggcccagggagctgcggcgctcagaatgcggtgacagcgccgcctcgcgtcccttccctgacctgctcccggcggacgcggagaagtttgttggcctggaggctggaatataccggggatcaaatgcagagaatggagaaaagagggaaggatggggggacgtgttgaagaaatgagggaagagatagga

SEQ ID NO: 415121 - DNA, 494 bp, Homo sapiens
cttgggggcgcacgcctgtagtcccagctcctcaggagctgaggtaggagaatcacttgaacccaggaggcaaaggttgcagggagttgagccaagatcgcgccattgcaccctagcctgggcaacagagcgagattctgtttcaaaaaacccccaagtgtattataaggcaataattcctatacgaagcaaactaaaatgcagcaatattaaggtataaaaacaaagaggaataattccattgaaccttgattctggaaactttgatccacccagcagtcatgatgttagactcattgaaaagaatgtatttctaatgcatgatgcgatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagt

SEQ ID NO: 415122 - DNA, 2841 bp, Homo sapiens
gggctgtgctcgtcgccgcgctcgtggaccggggccgggcggactcggggaccggcggaggacgccgggcgcgcccggcccgaggctgggggagcggggcggcgtggcgggcgcgccgaggaccccaggccgggccgggccgagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggcggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgattggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcactccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgcaccgccgcctgca

SEQ ID NO: 415123 - DNA, 2937 bp, Homo sapiens
gggctgtgctcgtcgccgcgctcgtggaccggggccgggcggactcggggaccggcggaggacgccgggcgcgcccggcccgaggctgggggagcggggcggcgtggcgggcgcgccgaggaccccaggccgggccgggccgagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggcggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgattggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcactccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagacggacccgttccctacacccctacctacactcgaggcgctccccgtctcccacctggcctttaccgcctcgcattccctccctcgcccc

SEQ ID NO: 415124 - DNA, 826 bp, Homo sapiens
atttttttttctttttagatggagtcttgctctgttccccaggctggagtgcagtggcacgatctcagctcactgcaacctctgcctcgcaggttcaagcaattctcatgcctcagcctcctgagtagctgggattatggatgccccccaccatacctggcgaatgtttgtatttttagtagaggtgagatttcaccatcttggccaggctggtctcgaactcctaacctcaggtgatctgcctgcctcagcctcccaaagtgctgggattataggtgtcagccaccatacctggctgagactggagattaaaatggggagggttagggccaggctcactggctcaagacggtgttttgggaagccaaagtaagactaatcacttggggaccagcctgggcagtatagcaagacggaatcctctaacaaaaaaaatttttttaggttagccaggcacaaaaaagcatgcctgtggtcccaggtactcgggaggctgaggtgggaggatcgcgtgagcccaggaggtcaaggctgcaggaagctatggttgtaccactgcactccggtctgggcaacagagcaagaccttgtctttaaattttaaaaatgggggcttgggggactcagagaaggcaggcaaggcctggagtgcatagcagatggcctcgggaagaaggaatgaggaaggacaggatccggagagggtgctcccaggaggagcgatggggcagcgggtcctggaggggcggcacggttcaggcgggtgtcaccgcacctcacacccgagcagccgtggccaccaggtggccgccctggccctgctccc

SEQ ID NO: 415125 - DNA, 2878 bp, Homo sapiens
gggctgtgctcgtcgccgcgctcgtggaccggggccgggcggactcggggaccggcggaggacgccgggcgcgcccggcccgaggctgggggagcggggcggcgtggcgggcgcgccgaggaccccaggccgggccgggccgagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggcggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgattggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcactccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgcaccgccgcctgca

SEQ ID NO: 415126 - DNA, 1547 bp, Homo sapiens
aagcttggcacgaggcctcgtgccaaaaaatgggggcttgggggactcagagaaggcaggcaaggcctggagtgcatagcagatggcctcgggaagaaggaatgaggaaggacaggatccggagagggtgctcccaggaggagcgatggggcagcgggtcctggaggggcggcacggttcaggcgggtgtcaccgcacctcacacccgagcagccgtggccaccaggtggccgccctggccctgctcccctcaggctggtgttgtccacagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgattggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcactccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgcaccgccgcctgca

SEQ ID NO: 415127 - DNA, 1045 bp, Homo sapiens
ccaacgctcagcacagcagagaaagacaccaagctacgggacccgccgcgcctcccgcgccggggtggagctgaccccgccgagccccgccccagcctgcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagtttctactgaaatacaaacacatttcattaactgctataggatctgtctgctaatggtgcttaaattctcccaagaggttctcacttttatttgaagg

SEQ ID NO: 415128 - DNA, 998 bp, Homo sapiens
ccaacgctcagcacagcagagaaagacaccaagctacgggacccgccgcgcctcccgcgccggggtggagctgaccccgccgagccccgccccagcctgcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagtttctactgaaatacaaacacatttcattaactgctataggatctgtctgctaatggtgcttaaattctcccaagaggttctcacttttatttgaagg

SEQ ID NO: 415129 - DNA, 2898 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415130 - DNA, 2646 bp, Homo sapiens
ccgcctcctctccgtgtgggggcgggggccccaaatttggtgggtgggccataggaaagccaaggccaaggcctggtggaggtggtgggggtggcggaggaggctgcagaggggggagtcccaaaggtggtagtggcatgggaattccagggagctgtgccgacatgggaggtggagcggctttgtccccatcttctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415131 - DNA, 1151 bp, Homo sapiens
  misc_feature (798)..(798): n is a, c, g, or t
  misc_feature (806)..(806): n is a, c, g, or t
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtnggaccacncaacgaccatgaccatacaaacgcgaaacggatacacactagtagaaccagaagcccacagcatgaaagaaaaacgaaaaagaagcggaagccaggagagaaataacaacacgagaaaacaggcaggaacagacggcacacgacataggcagcagcccacagctcagcagagagcacacgccggagcccacacgaggagaagacgcgccgtaacgacgcacgaagcacaccagagcgatgacccgccaacagcgcgacgagcaacaaagccgccgagccaccaacgaccatgcggcacacacgacaaagaacaaaatgagccacgcgaacaacaacgagtagatg

SEQ ID NO: 415132 - DNA, 1401 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccaggtaggtgttggcggcgggacgtcaggataggccgagcttctccaggagaccttatataccccatcacggctcggtcttcattctttctttatctcggcacagcaaggcggaggcttgccctttttagcttgttcttgcctttgccagcttagttgtaatttcttgtatccatcttggtcctcttcagtgcccagccagagcgctggcagacaggcactgggtacgttttgttgaatgaattgggagcgaacgtcgtttagtgaaacagctagttttggactgacctagagtcctttctcttttgcagactggcatcgtgctgaatcggccggttttgagaggggaagatggggacaaagccgctccacctcccatgtcggcacaggtagggagattcttctgttttttaagattccatctgctgatccttttgtagttcatgagcatgatgattgggtgttcacgtgcatgtgtgagatgtgacacccttgcacattactcgcctgacctgagtggggaaaaaaaaagattccatatgttcagggtagcccttcctctcacttgcagttgttgggcagggaggtactgccatgacagaattgtgagctcttcagttctctctttgatgctgacacttgcctccttttccactgtctgcttctccaaaagcagcttgtggccgggtgcagtggcgcatgcctgtaatcccaccacttcgggatgcttagatgggacgatcgcttgaagccaggagttcgagaccagcctgggcaacatagtgagactctgttactacaaaaaattttaaaaattagctgggcacggtggcacgcgcctataaagtccctataaagaggctcaaggattgctggagccctggggttggaggctgcagtgagctctggttgcgccactgtactccatgtactccatcctgggtgacagaatgagactttgcttctttaaaaaaaaaaggggggaggtgatgggggaggggctgggagagtgtcagaaaaaatagctaatgcatgccaggcttaatacttaggcagtgggttgataggtgcagcaaaccaccatagcacacatttacctatgtaacaaacctgcgcatactgcacatgtacccgaaaacttacaataaaataaattaaaccaaaaaaaag

SEQ ID NO: 415133 - DNA, 425 bp, Homo sapiens
gaaatcctccagtgggctgccctctttaaggacgatgagggggaggaactcagccaagtctgagagggagctcgaagagaattcagattcagcgcctttcccacagacttctatgtctatgtcaggctgcccacccttgttttgggggtccgggggtggttcaacctgtcttaacctgtgtctctttctccctatacagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415134 - DNA, 1031 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccaggaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagcaggcacatggaaccagatgactcgcacgcacatggagccagccagcgtcagacactgccgaggacacaggtccgcatctcaaaaggagaaaaacggacgcgtaagaccgagagaagacaaaccgccccaccggtgccacagggcccccagcacagccccgagggacagcgaaaacacacaaaccggatcagcgcacctgatgatccccaccgacgagcagcaacgaacatacaagacagcacgcgaacacacagacacaagaacaacaacagaatatcagcaccagaccagcaaaggcagagccacgccgcgcaccacagccacacagaacgagggaaatcaggagaggaaaacagacagccaacgacaagagcaagacacgagcgaag

SEQ ID NO: 415135 - DNA, 677 bp, Homo sapiens
gaaatcctccagtgggctgccctctttaaggacgatgagggggaggaactcagccaagtctgagagggagctcgaagagaattcagattcagcgcctttcccacagacttctatgtctatgtcaggctgcccacccttgttttgggggtccgggggtggttcaacctgtcttaacctgtgtctctttctccctatacagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatattatatttaacactcctgagcctccctcatctccttttagccccttcttgcaaaaggactaaaatagtctctttctacaatcactgggctgccccagtaaccacgaacataaactgggattagacggcgcatttgactggtggtgacgccaaccccaggctgaaatctgtgtttcaccactgccctgctttgtaggaaggcttgggggaagtacctctaggtctggtttgaccttactactttgtccttggggag

SEQ ID NO: 415136 - DNA, 2665 bp, Homo sapiens
  misc_feature (28)..(28): n is a, c, g, or t
  misc_feature (30)..(30): n is a, c, g, or t
  misc_feature (42)..(43): n is a, c, g, or t
aacataaggctagtacgaggctggtttnantcggccgagggnnagatggggacaagcgctcacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415137 - DNA, 3361 bp, Homo sapiens
  misc_feature (2909)..(2909): n is a, c, g, or t
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatattaaaaaaaaaaanaaaaaaaaaaaaaagaaagaaaaaaaaaaaaataacaacaaaaaaggggccaaaaaaaaaaaagaaaaccaaaaagctaggagtaacaaagatgtggggtccacaataatagaggggaagttaatatatattaataaaagctcaaaggcacgtgggcacggagacgttattaacaaaagtgagggaacgggggaaaaacgcgtgttaagttgtggagaatctatgtggtgaaagggcaacttaatttcggtgagaaagataacaataattgggcacaacaattaacatgaaaggagatattttcaaagggatgagtaggggtaacacttaggcggagtttaaaaggggctaaaggagggttaaactcgagcggacatagtgtgtatggattgaacatttgggatcatgacaattgattatggaagttatatacagggagttgtgaaaacata

SEQ ID NO: 415138 - DNA, 2972 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatattattaatttagtaagtattattattttaatataaaataaaaaattgccatcatttacaacttctaattggtaaact

SEQ ID NO: 415139 - DNA, 3150 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatattatatttaacactcctgagcctccctcatctccttttagccccttcttgcaaaaggactaaaatagtctctttctacaatcactgggctgccccagtaaccacgaacataaactgggattagacggcgcatttgactggtggtgacgccaaccccaggctgaaatctgtgtttcaccactgccctgctttgtaggaaggcttgggggaagtacctctaggtctggtttgaccttactactttgtccttggggag

SEQ ID NO: 415140 - DNA, 2087 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggaattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415141 - DNA, 2844 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415142 - DNA, 2926 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggagggttcgagtcgaacattggtgcgagtagagtcagtgctagcccgaaaccagaagctaacaaaaacgagagagatcagccccaggacaagcccgtgaggggcagacaagagagataaaggagattcaagcttgtaaggtcccctacagcacctacgccctctggatttaggccttacagtccaggatgccatgggatttaacacaagggaccactttatccgagcagttctcgaagacgtttgtcactttaatgttcgtattgtaaccgatcctgagtactcaagtgtttcacg

SEQ ID NO: 415143 - DNA, 3010 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcatgtagctgaccagcctaccagatcttttatgcgatgatgggatccatggtaccga

SEQ ID NO: 415144 - DNA, 1583 bp, Homo sapiens
attgactctacaggatcctttgtccatcccccttcgtgatcacagcatttatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415145 - DNA, 2594 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacgttatgagcggaagggcggtctgagctgagggtgaatgggcgggctgaaagtggtggtcatgcatacaagttaggcttgggacgggtatggaggaacggcttaacgggt

SEQ ID NO: 415146 - DNA, 2705 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaaagtgagacaaccctcaagctccttcacgtgtgttcgccaggacgaagaagaacaaggcacttggtggagggggccattggatggggttcaccccaccatttatgaccgtgtcaccggttattggaccgggagaggccggtcctggaggctgcaaagtgtggaaagtgggccctggcgcctgaaaaagttggagctggttcattgggcaaggaccacaaagttttagggcgctcgtgcggagacagacgtccatagaaaggagaccgactgggggacaccgaacaagaaaaaaggaggccccgaacggggggcaaaag

SEQ ID NO: 415147 - DNA, 2345 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtgaccttatcactcctggatggctttttctatcactgtctactgcgatcgccagttatact

SEQ ID NO: 415148 - DNA, 1310 bp, Homo sapiens
cttctcaatgccccgtttgccctgcaggtatttgcgcttaaaacaccagtggcgtggcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415149 - DNA, 1106 bp, Homo sapiens
  misc_feature (14)..(15): n is a, c, g, or t
taggtcggtaccgnnattctccttatggggactgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415150 - DNA, 1215 bp, Homo sapiens
ctgggcgccctgtgggtttgcaccttccttgtgagggaaatcgtgtcacttaacgaaaaatgaagaaacgcggagtctgctttatgtcatcctcgtggctctcgaaatgccttatttggccagtggctctgcgaccggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415151 - DNA, 2041 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415152 - DNA, 942 bp, Homo sapiens
gggtgactctagaggattagtgtcatcccccttcgtatccaacttaaaatcctgggctgaactcgccatcccatgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415153 - DNA, 1289 bp, Homo sapiens
tagtttaggacctgtggcagctcgcacctgagttaactcaggggcgagctgccggtaactcaggggcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415154 - DNA, 963 bp, Homo sapiens
tgaagtctagcctgggtgttgccatggatggagggaagagtaggctggcctgtggcgtgggtgggaggagaggggacggagagggcactcggcccgctgcaatctgacccctctctcctcagggcaggaaacacagagtcagacagtttgggggggggggaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415155 - DNA, 1983 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaatagacgctctagtgggcatcgagacagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggttactcatccgttgaaccgaaaagg

SEQ ID NO: 415156 - DNA, 1734 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcggaccctaattagggtccgctgttcaatcctgaattacggttttctgtttgaaaacacgaaatatgcgagttagagactggggataaatgtggagagggtcctgaagtcaaggagaagattttaccaaaactagagcacttcaatggagaattagccgggcatggtggctcatgcctgtaatcccagcactttgggaggccgaggcaggcagattacttgaggtcgggagttc

SEQ ID NO: 415157 - DNA, 570 bp, Homo sapiens
  misc_feature (51)..(51): n is a, c, g, or t
  misc_feature (55)..(57): n is a, c, g, or t
tgctggaggtgatctagaggatcttcaaaagtgcactcttctatatctacntggnnngaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415158 - DNA, 558 bp, Homo sapiens
tcatggacgccaccaagaggattatgcagatgctgaagctggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaaaatatta

SEQ ID NO: 415159 - DNA, 865 bp, Homo sapiens
ggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccagcccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggtaatacccctccccctaacctttgacctcgtggtccagtcagttggctgtcatttatagtgcttagagtgcaccattcaagttttccctggaggctactttgttctcaactaagttctagtatcttccaaagctttcaatttttcttgaagttcaggaattgacaaactatgacctgtggcctgcatgtgtatggcctatgagctaaaaataactttaaaatttttagctcataggccatacacatgcaggcacagtcg

SEQ ID NO: 415160 - DNA, 1129 bp, Homo sapiens
  misc_feature (28)..(28): n is a, c, g, or t
  misc_feature (30)..(30): n is a, c, g, or t
  misc_feature (42)..(43): n is a, c, g, or t
aacataaggctagtacgaggctggtttnantcggccgagggnnagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcggaccctaattagggtccgctgttcaatcctgaattacggttttctgtttgaaaacacgaaatatgcgagttagagactggggataaatgtggagagggtcctgaagtcaaggagaagattttaccaaaactagagcacttcaatggagaattagccgggcatggtggctcatgcctgtaatcccagcactttgggaggccgaggcaggcagattacttgaggtcgggagttc

SEQ ID NO: 415161 - DNA, 244 bp, Homo sapiens
tgctggtggctggggcaaacctccagtggatgagactgggaaaccgctctatggggacgtgtttggaaccaatgctgctgaatttcaggtatgggccatgtactagcgatcttggttttacttaatgtcatgaaggttagattgttggtttatagcttcattatcagggagttgtgtgttctgacacagcagagcctggaaaagggcatacattttcctgagatgttaatgtaagctcctcact

SEQ ID NO: 415162 - DNA, 172 bp, Homo sapiens
gggctcagaggtgggtgagaggcagcggtgaacaggcatcttttagtgctggccttaggaactgggaaggggctcagagggcaggggtttcaccttgtctgcctccttagctcactgatgatgtgaagaaggagaaagagaaggagccagagaaacttgacaaactggagaa

SEQ ID NO: 415163 - DNA, 789 bp, Homo sapiens
ttggggagctcagaagctctccaaggcgctgagtggaggtgccacctgtatcttttgtttccgcttctggagacccttttgtcccttgctttttgggcctgatcccattgtccttcgcagaagtgagacacctcagctcttcactgtgttgccagagaagagaacagccactgttggaggggccatgatgggatcaacccacatttatgacatgtccacggtgagtacttggaggatactgcttttggaggctgagaaaggcagcagaagctagggcttctctgactctttggagatgaccaggccctgatctcctttccaggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaaggtaggcgcttccaggggcgctgggctgggtgagagccagggaccctggcctgccgttttcagtggcatggtgccctctagtggtgagagtgagggtggcctctgcttgctgctctgtgcttccttagatttggaagtcttagaaatcctccagtgggctgccctctttaaggacgatgagggggaggaactcagccaagtctgagagggagctcgaagagaattcagattcagcgcctttcccacagacttctatgtctatgtcaggctgcccacccttgt

SEQ ID NO: 415164 - DNA, 415 bp, Homo sapiens
agtaaatatatagtttaatggttttttacacactgaacacacctgtacaaccagcacctggaccatgatccaaaacattaccagcattccaaaagccacgccacgtgccctcctcccctgcaggtttaccatcaccctttcagcaagagaggtaattttttacgtgagtgttttgcctcttctgacattggatttctttttcccgtctcttagtagctgctccagtgggcccagtgggccccactcctacagttttgcccatgggagcccctgttccccggcctcgtggtcccccaccgccccctggagatgagaacagagaggtgagactgatgatttattcctagggataagagagtggtagtttaggatgggactatttttggatttttagagaaaggttctgtgagaagat

SEQ ID NO: 415165 - DNA, 488 bp, Homo sapiens
gccgccgccacctccaggccactatggcgcctgggctgcccaggagcttcaggccaagttggcagagatcggagctccgatccagggaggaacacaggaagtcgaggggcctttacgggcctgcggagaagcggagcctggttacccgggagactcgggtgcgaggggcggaggcaggccgctggggcctgacctggccgggctggcctgccccattgatcgtgtactttgccctgcaggtaatcgcgaggagctggtggagcggctgcagagctacacccgccaggtaggtgttggcggcgggacgtcaggataggccgagcttctccaggagaccttatataccccatcacggctcggtcttcattctttctttatctcggcacagcaaggcggaggcttgccctttttagcttgttcttgcctttgccagcttagttgtaatttcttgtatccatcttggtcctcttcagtgcccagccagagcg

SEQ ID NO: 415166 - DNA, 2637 bp, Homo sapiens
  misc_feature (1249)..(1249): n is a, c, g, or t
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggnttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaa

SEQ ID NO: 415167 - DNA, 2754 bp, Homo sapiens
  misc_feature (741)..(741): n is a, c, g, or t
  misc_feature (1366)..(1366): n is a, c, g, or t
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcncccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggnttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaa

SEQ ID NO: 415168 - DNA, 2595 bp, Homo sapiens
  misc_feature (1207)..(1207): n is a, c, g, or t
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggnttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaa

SEQ ID NO: 415169 - DNA, 629 bp, Homo sapiens
  misc_feature (47)..(47): n is a, c, g, or t
  misc_feature (50)..(50): n is a, c, g, or t
cttctccctccacccgcttccgtcggccgggcccctcccgccccgcncgncggctcgcccacccggccccggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaa

SEQ ID NO: 415170 - DNA, 2732 bp, Homo sapiens
  misc_feature (1249)..(1249): n is a, c, g, or t
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggnttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaa

SEQ ID NO: 415171 - DNA, 669 bp, Homo sapiens
ccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcc

SEQ ID NO: 415172 - DNA, 367 bp, Homo sapiens
ctgaggcaggagaaccgcttgaacccaggaggctgaggttgcagtgagccgagatcgcaccactgcattccagcctaggtgacagagtaagactccgtctcaaaaaaaaaaaaaaaaggtggtaagtcgatggcaacatgaagttagggtttagggcattgttagaagaatgggatggagggtggtttgcatgagcctggaagaccggggactggtgacatctcttatatttggtatttgtgggtgtgaatactagggattgggcaaacttctttaaaaagccagatagtaaatacttcaggctttgccactcacatattgtttgttgcatatttttatttgtttggtttcataaatcctttaaaaa

SEQ ID NO: 415173 - DNA, 522 bp, Homo sapiens
gagaattacttgagtaatttcagctgtgtttcagttaaaagtaatacatttatgtctgaagtgatttgtaagtcttttagtttaaaatttttaattttaaaaagtcatttaaaattttttaggtatgagaaataataaacataaactttaggcattcaccctttctagttggtaagattcgagctgtctttatccctcttacttgtggttgatggataatttcatgacttacagatggaagaaaatagaatctttatatgtgattcttatattgacataaaatgagttatattcttttatacttaaaatattagtgcaagttggacttttattaatagaaattgatgttgctttaaaaattaaatgatctgaagaaattttcttctctaaaattaatttacatgtagttgaatatatccttgagacactttgagtgagtagaaaactgacttcaagggacaaaattattctcatagatgctaaattgaaggcctttgtaaatctggaggttaaaaagtataa

SEQ ID NO: 415174 - DNA, 485 bp, Homo sapiens
ctgacatgcctcaagtttgtatgtcacctgacgtaactttacttaaaatgcctcttacattatcttctggtaagaactgtttattctggtcaggatcagtataatatgaattcttttttccaaatgaatttcttttaacttttgatgaaaaagaagagtgatcatttattcaacatatctttattgcacttactgcaaaatataccacctgctgcagtgggggggattcaaagatatgtaagttttagttctttttctcaaaagtttataggttgttagggaaattaaagcatgaatataaatagttgtaatacagagtatctgtgaaaagctaaaagccctataggactttatatgtgtgagagagaatttcatctggcttgcaatgatatgcatctttacttgttttaaaaatatcatcactgaacatgagacctaaatgtattacttcaacagaaagctaattgttgacttaagccatttta

SEQ ID NO: 415175 - DNA, 3497 bp, Homo sapiens
attctcatccggggtcacgtcggtcttccgggtgtctttgacagggttttctacgccgctttttcggcgacttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415176 - DNA, 3453 bp, Homo sapiens
attctcatccggggtcacgtcggtcttccgggtgtctttgacagggttttctacgccgctttttcggcgacttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415177 - DNA, 3220 bp, Homo sapiens
tctttttctttagcaacaatattgtgttaatttagtacaggttgagtattcattatctaaaatgcttgggactagagttttttggattgtagatttttttttttgaatacttgcattatacttaacatttgaacatccctgatgcaaatctgaaatgctccaatgaacatttcctttgagtatcatgtcagcactcagaaagtttcagattttggatttcaggtttttggattagggatgctcaacctgtagtatgtttacctgaatttcctgttaactgatactcctgtgtataatactgtagtaattggtattcattaagctgacttgaggcagcctttttaagatgctgaggtttcttctgaactaccaatgattaattaagctcagtgtaattttaatatgccttattatgttttacatctttaaaaatacaaaaaattattgagtgttaatgtatatttttactattcatattattccactagcgaaaatgacttctagttactgcaagtcagaaagagatttattccaggaagaatgatatttttctaggctttgaaatcatataaagagaaagtttaaaaaaactcacattataaacagtggagagtacaagggttgtaattaaaactttttcgtgctgctagattatactcaagcacatcccactcatcctctagtgttattcacatatctaaatcatgatgtcatagcttttacacaaactgaggcaccatagatatgaaactatccttgagcagcttaaaatctagatagggctaaaattctgtttatttttgttggaggttgctttttgtacatttatgctgaaggggaaaatgacatagatggctatttcagaatttctttgaaaattgtgctttaagcttaaaatcaggaattgatttagaaatgtagatgtgaaagatagcattaaaggttgactttttctgttatttagaaaaataaattgaatatactttgagtatattgaaaaataactccaaaggaaagtatatcttgtatgttttctttttgttgagatactttaggaaaatgaaacattaaacttagaaagataatgaaaacacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415178 - DNA, 3311 bp, Homo sapiens
attctcatccggggtcacgtcggtcttccgggtgtctttgacagggttttctacgccgctttttcggcgacttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggaccaaaagaggaagatagtcttgggacccttgcatggtgtttcaaagggtggtgaagaactaaggggctccagagcttgatatatttctgggaatttggaatatgctaaactagatttctgccctagactaaacatctggctgtggactcaatgtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415179 - DNA, 3222 bp, Homo sapiens
attctcatccggggtcacgtcggtcttccgggtgtctttgacagggttttctacgccgctttttcggcgacttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415180 - DNA, 3055 bp, Homo sapiens
attatctgagttgcagctcatttttgaatttcttcgttgtccaatgtctttatagctttattgaaaagtagcccttttttataactagcactcagctcacttaatcgtatcttccttatgttatagtttggatcttcttagtaattctataaatagaacttttcctacaaagttttcactactgagatgaaacattggggtagttcaaatacaggagactaacctcaatatatacatgtagttttttctgtctccattattactattttttttaaggtgttgagaggcatttcttgtgctgaacatgaatatttttaagatccatataaagctaataaagtgaccttattgaaagaatcatattgtcattatctcttatgatatttatatatatttaattgctttttatttgttatcagaaagttgtatctttaattactaaggtatattgcttgttttcaggagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415181 - DNA, 3108 bp, Homo sapiens
attatctgagttgcagctcatttttgaatttcttcgttgtccaatgtctttatagctttattgaaaagtgtttcttaattggtctttcctgctgatgagtcagaacataggtgtattcaaagagcccttttttataactagcactcagctcacttaatcgtatcttccttatgttatagtttggatcttcttagtaattctataaatagaacttttcctacaaagttttcactactgagatgaaacattggggtagttcaaatacaggagactaacctcaatatatacatgtagttttttctgtctccattattactattttttttaaggtgttgagaggcatttcttgtgctgaacatgaatatttttaagatccatataaagctaataaagtgaccttattgaaagaatcatattgtcattatctcttatgatatttatatatatttaattgctttttatttgttatcagaaagttgtatctttaattactaaggtatattgcttgttttcaggagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415182 - DNA, 2247 bp, Homo sapiens
gtttgtttattaaaaattagcctttttttctttattcatttttaaagatgtttggcataaatagtgacatctctttagttgtgtttaagtatagtgtatcttattttatttgtatatgttgctacactaaaatcatatactgtcagttataggtgaatcaagtggcattttaataattgataatttttaaaaggtaactaaggtaagttttagacataagacacaaagtgaacagacacagtgtttaatatacacggagacagtgttctttgttttggtatggagctgggaaatgatgtaaactttcaaagaaactataacgtctcttaccatgttaagttttaattttactttcagttgaaaatcgagttcgtccgttagtgctggtgattaagaagtgggcaagtcaccatcagataaatgatgccagtcgtggtactttaagcagctatagtcttgtattgatggttttgcactatttacaaagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415183 - DNA, 3442 bp, Homo sapiens
attctcatccggggtcacgtcggtcttccgggtgtctttgacagggttttctacgccgctttttcggcgacttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgttttaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaatga

SEQ ID NO: 415184 - DNA, 1594 bp, Homo sapiens
attctcatccggggtcacgtcggtcttccgggtgtctttgacagggttttctacgccgctttttcggcgacttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataaggtaataataatgtagattttagttttgccttttgggaatttagtataaataatgtattaatcaaaaatatttaatatcctggattaagtagaacgtgcctttttttgttgcaatgtttaaagtactattcagcctaattttctgtccaaacattactttgatttttgttagctattcttttatagaaatgcagccatcaggaaatcagattttccctgatatatgaaaattttattagaacccagacactttctgagtttagagaactgtcttgttacttgtttttactgaaaaaaaaaaaagttgtcatatagctattgtaatacagtgttagaacacattttattatgggatatttgtgttataacatgaggttttttgaatgtcaaaaatagagaatccaggagtcactgagaaaaacaatacattcaaagtgatataatcaagaaaga

SEQ ID NO: 415185 - DNA, 1688 bp, Homo sapiens
attctcatccggggtcacgtcggtcttccgggtgtctttgacagggttttctacgccgctttttcggcgacttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggcagtttggcttgatgtaaccattgttggtagaaccttcctccaaacttgtctctgaaaccggtcgccgtgcgggataaaagggacccacaaatgcgcggatacacattttggttgcaaaccctaccccccccaatcagtcgacgtacggttccaaaagccggatatgtacccctttcatccgacatcctctggg

SEQ ID NO: 415186 - DNA, 1367 bp, Homo sapiens
attctcatccggggtcacgtcggtcttccgggtgtctttgacagggttttctacgccgctttttcggcgacttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaagtaaggaaacattt

SEQ ID NO: 415187 - DNA, 1152 bp, Homo sapiens
attatctgagttgcagctcatttttgaatttcttcgttgtccaatgtctttatagctttattgaaaagtagcccttttttataactagcactcagctcacttaatcgtatcttccttatgttatagtttggatcttcttagtaattctataaatagaacttttcctacaaagttttcactactgagatgaaacattggggtagttcaaatacaggagactaacctcaatatatacatgtagttttttctgtctccattattactattttttttaaggtgttgagaggcatttcttgtgctgaacatgaatatttttaagatccatataaagctaataaagtgaccttattgaaagaatcatattgtcattatctcttatgatatttatatatatttaattgctttttatttgttatcagaaagttgtatctttaattactaaggtatattgcttgttttcaggagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataaggtaataataatgtagattttagttttgccttttgggaatttagtataaataatgtattaatcaaaaatatttaatatcctggattaagtagaacgtgcctttttttgttgcaatgtttaaagtactattcagcctaattttctgtccaaacattactttgatttttgttagctattcttttatagaaatgcagccatcaggaaatcagattttccctgatatatgaaaattttattagaacccagacactttctgagtttagagaactgtcttgttacttgtttttactgaaaaaaaaaaaagttgtcatatagctattgtaatacagtgttagaacacattttattatgggatatttgtgttataacatgaggttttttgaatgtcaaaaatagagaatccaggagtcactgagaaaaacaatacattcaaagtgatataatcaagaaaga

SEQ ID NO: 415188 - DNA, 327 bp, Homo sapiens
gtattactggagcctccaaccttagaagaatttgataatgtcctcacttgtattctttttcaaagacgttttcttaaattattttagcttagtaaatactattttttaaaaaatgtgcgttggaacactgtgaattctagaaacatttgcagctattcacattatcttttgtctttcagcgggctacattgagagacctcagctgattcgagcaaaagtgccaattgtgaagttcagggataaagtcaggtaaataattaatgagctttctttttttagttcctttagatcatttttagatactcatctgataaagataattaagaa

SEQ ID NO: 415189 - DNA, 740 bp, Homo sapiens
ggattgggcaaacttctttaaaaagccagatagtaaatacttcaggctttgccactcacatattgtttgttgcatatttttatttgtttggtttcataaatcctttaaaaatataaaaaaattcttttctcaggggccatactaataaagtgagcaagtgttaaacagtttgctgacccatggattatttttattacgaagtatctgtgactgtacttttctgtgacttgtatattttactttgtaaaatttatgtgtggtttttcagaccattctcttcctgtacttgagtaatagtagctttgttttgggaaatattaagaagataatacatactcccttttaaaatagtgtcagtataattgatttatgcttctccatatagcaattacttttacattgctgaacaaaacttttacttttttttgcggtggattcaagttgagtcagcagatactggagttatttgaaacatgtcagcagcaaataagtgatttaaagaagaaagaactctgtcgaacacagctgcagagagaaattcagctgttatttccacgtatgtttccctattttgcatgtcctttaggtatatgcattcctattttaaattttatcttttttttttttaataggcacagaaccatgcacctactttagattttaaatactcttattactttcttctgtttctttagaaagcagactttttttggttgggtcctctttaaatggatttggta

SEQ ID NO: 415190 - DNA, 641 bp, Homo sapiens
gttggaggttgctttttgtacatttatgctgaaggggaaaatgacatagatggctatttcagaatttctttgaaaattgtgctttaagcttaaaatcaggaattgatttagaaatgtagatgtgaaagatagcattaaaggttgactttttctgttatttagaaaaataaattgaatatactttgagtatattgaaaaataactccaaaggaaagtatatcttgtatgttttctttttgttgagatactttaggaaaatgaaacattaaacttagaaagataatgaaaaaacactttatttttaacttttcagtgtttttttcaggtaaatcagaagactgaagcacggcatatactcaccttagtccataaacacttctgtactagactttgtaagtctgacatgcctcaagtttgtatgtcacctgacgtaactttacttaaaatgcctcttacattatcttctggtaagaactgtttattctggtcaggatcagtataatatgaattcttttttccaaatgaatttcttttaacttttgatgaaaaagaagagtgatcatttattcaacatatctttattgcacttactgcaaaatataccacctgctgcagtgggggggattcaaagatatgtaagt

SEQ ID NO: 415191 - DNA, 533 bp, Homo sapiens
taggccttagtattgatacaataaaaataatataagagaaattatgaaaatagttaacatggttactgtttttcttcttatagctggaatagtcaaatgatttcagttcgtgaagccaaagccattccaaggcctgatggtattgaatggagaaataaatacatctgtgtagaaggtagttttctgtttaccatctacgtatcatcatggtactaagagaattacttgagtaatttcagctgtgtttcagttaaaagtaatacatttatgtctgaagtgatttgtaagtcttttagtttaaaatttttaattttaaaaagtcatttaaaattttttaggtatgagaaataataaacataaactttaggcattcaccctttctagttggtaagattcgagctgtctttatccctcttacttgtggttgatggataatttcatgacttacagatggaagaaaatagaatctttatatgtgattcttatattgacataaaatgagttatattcttttatacttaaaatattagtgc

SEQ ID NO: 415192 - DNA, 478 bp, Homo sapiens
gtgagaccttatctcaaaaaaagaaaaaatttgaaggaaaaaattattcaaaatttatcacctagagagaaccaactattaacattcttttaaactctcagtcttttgttctgcataaattttaggttttaagaatgatttttctttctctcccagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtga

SEQ ID NO: 415193 - DNA, 6159 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaa

SEQ ID NO: 415194 - DNA, 6248 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtgtgagtgtgtggggccgggccgcccgcgtgcgagcgtccccgtggtctggagagtgcaccttcaggtgccggacgctgctcccttacagatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaa

SEQ ID NO: 415195 - DNA, 6143 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtgtgagtgtgtggggccgggccgcccgcgtgcgagcgtccccgtggtctggagagtgcaccttcaggtgccggacgctgctcccttacagatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactggtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaa

SEQ ID NO: 415196 - DNA, 6084 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaa

SEQ ID NO: 415197 - DNA, 5988 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactggtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaa

SEQ ID NO: 415198 - DNA, 5223 bp, Homo sapiens
ctcagcttgggggcttgtcacccttcaagagccatttccgcaggatgacagtggtgaccgcagccttccagtagctcctgggaggcacagtggtgggtgccagagcttgtgtcacgttgggggcctgtgtgacctctgactcctcatgttagcatttggaatgttcagtggcttccagcttggctcggctcccacactcccaacagtggctgtaaaggaagccccctgcggccacatcctgctgtgagggcatggcgggcgggctcgacatgtctgcttttgccctcgccctcgcagggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaa

SEQ ID NO: 415199 - DNA, 5717 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtgtgagtgtgtggggccgggccgcccgcgtgcgagcgtccccgtggtctggagagtgcaccttcaggtgccggacgctgctcccttacagatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaa

SEQ ID NO: 415200 - DNA, 6299 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtgtgagtgtgtggggccgggccgcccgcgtgcgagcgtccccgtggtctggagagtgcaccttcaggtgccggacgctgctcccttacagatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaatatatttatggctacaatttcccatttttatttctaacacacttggctcta

SEQ ID NO: 415201 - DNA, 5033 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtgtgagtgtgtggggccgggccgcccgcgtgcgagcgtccccgtggtctggagagtgcaccttcaggtgccggacgctgctcccttacagatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagcctatgctctcgctgatccctccgcctgcaatggcactcattctggtaatcgcctttcccgagt

SEQ ID NO: 415202 - DNA, 2281 bp, Homo sapiens
acgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtgtgagtgtgtggggccgggccgcccgcgtgcgagcgtccccgtggtctggagagtgcaccttcaggtgccggacgctgctcccttacagatgcagtcggatttcttcctgccaaagccccggaagctgcggaaccggcacctgcggaagccactggtggtccaggtcagggtcttctcaagtctgaacgtgtggcctcgtggctgggccaaccaggacacagggcttcttccctctctcacattttcatggtgtaaaatgtgggaaattcctgccccttccttccctcttgtgagtagggtaaaaatacaagtaataacagtgaacttaatggtacccagaagtaaaggtaatctttcaataacatggaaatccacttgcaaaaaagacaattatagggattcaagtccaaagaatgtcccagattgggatgtatttatggaatctcaacacctatttataaacatttagtctgtgggagcagttgccagggcatgtgggtcagccagagcccaggcctctcatgagctccccaggagtccccgaggatgccgtatgcaagcctgggggacagccagggactcagaggcacctcagaagaagagcttggcattctgacgcataaaaatacagaaagtgaggtgggaagtctgaggtaattatggcctcagaaatgtatggatgtgtgttattttggattcatgcacaggtttccttttgttagactcttagaaatctctttctcccttgagattagtatatttacaaatgagacattgcatgaacggtcttaggaagaaagtgcctgctaaatcttaggtgttctttgttcaaactaagatcagggttgaaaactatggcccagggaccacttccagcctgactgttgttttgtttaatttaaaacaactttatagatagagaattcacatatcataatgtttgcccatttgaactttatgactcagtggtcacaaggtgtacgacgaccatcaccatggtctaatcccagaacgttaccacccagaaaggaaaccctgctcctatgaactcacgttgccttctcccgccagcccttggcaaccacggatccgctttctgtctctatggatttgtctgttctgggcatttcctataaatgggatcatacaatttgtgttcttttccacataatatttttgtaaataaagtttactggcacacagc

SEQ ID NO: 415203 - DNA, 1601 bp, Homo sapiens
agaggcggtgcggcacagaggagcgctcgcttcacaaggtgaccctagctcccaccgccaccgccgcggtcgcgctccagacgccctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgggctggtggctgccggctccatgacgcccgtggggtcaccccccggcccgggactcagccagcctcgcctcctcgctcctcgctcctcgcccctaggacgccaagggggaaaggagagggcggaaaaggaccagcgggatcc

SEQ ID NO: 415204 - DNA, 1389 bp, Homo sapiens
gcccgtcacacataagagcaaggaaactctctgaatgcccagcatactacaatgcacttgacccagagtttacaaccctctagcacaaaggtgcatctcaactcatgtgcctgtcagaagtgcacgccctgccaacgggaggcagaaatctcacctatgctccagggcaggtgggaagggcggctgggaacccctgtacccaggatgccttagaggaagggaaggcctccccaaagacctctacctacccaatcaagggcaggcccttattttcccttcttgggttccccagaggccgcagtaccctagcagaaacagttactgaggtggctgacagggtgtcccttcccaaatcaccctcccaccttaggcctacagccccacttcaatggcgtttgtgtgtctgtgtctgtacacgcctgtgctctggactcgctgtgcagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgggctggtggctgccggctccatgacgcccgtggggtcaccccccggcccgggactcagccagcctcgcctcctcgctcctcgctcctcgcccctaggacgccaagggggaaaggagagggcggaaaaggaccagcgggatcc

SEQ ID NO: 415205 - DNA, 367 bp, Homo sapiens
tcaaactcacattctaacaaaaaaaaaactaaactcgaggggtgttttcacaatataattattatatataacagaataattataataatgatacattgtaacagaatacagtcctttaaaagataagagttttatatttttaccaattcagagtcatgttgaatgtgactaataattagctaataaatccaactaatatgtccctatgtaagactgattttaatcagtgcagaaacaggcaatcttctccatcagaaaaactgaaaatgtctggcagtattgccatttatcacaaaaaggaaaatcagatttctcatatgttgcttgagttgaagggcagttatcaagaagcactttaataggtaaa

SEQ ID NO: 415206 - DNA, 2515 bp, Homo sapiens
tattcatcaagtgccctctagctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatgctcctccagggagtctcagcttcaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttattcactgtatgtccttggtgcctggagcctactaaatgctcaataaataatgatcacaggaatgaatgcatgctgaaaagaccactctttt

SEQ ID NO: 415207 - DNA, 476 bp, Homo sapiens
  misc_feature (232)..(232): n is a, c, g, or t
gtttattatattgtggctttaggacattaaacctcacttcaactgaaggtaatttgtaatttaagaaggagagggtagtagtggtattaggggcagtccttctatttgtctcataaacccaaatgtgaatgtgaaacaccctttgttgttatcattttgatttggtctggtcttttacaggtgttagtccagaagtgaatgaactattgatggaagcccagctgctccaggnatcccttcctgaaattcaggaactttaccagactttacttgcaaagccaagccctgctcagcagactgaccgaagctcaccagtgagacccagcagtgagaaggtgagtgtctgagaggcttctggggcaaggcacagtctggggtgggggtatgctttattttactcctcgaaacataaccagacagctggtgtgaggactgggcgattagactgaggatgacccattttgaatgctgactta

SEQ ID NO: 415208 - DNA, 344 bp, Homo sapiens
cagaatgatgagaaaaccgtatgtttctggaagttaggaaccagtcatgtttgtatcatgagggtgtgggcatttggacttcatagaatgttttcaatataattaagttttcatgaaatattggtaaaattaaaataatacatacaaagcagaactgtaagtcaataaatatgtatttaattcaaattttacaagtcaattattgtaaaaaaatttctatttgaagttgtgagaaaatataaatggaaaactcactacatttattcatcccattaatctaacatgtatattcataaacaactctttatttacccattcagtatttttgctgccttatataaatt

SEQ ID NO: 415209 - DNA, 1632 bp, Homo sapiens
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggaaaaaaaaaaaa

SEQ ID NO: 415210 - DNA, 2354 bp, Homo sapiens
ggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415211 - DNA, 2057 bp, Homo sapiens
ggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaaggga

SEQ ID NO: 415212 - DNA, 3130 bp, Homo sapiens
taaagaggtaatccaagtaaaatgaggtccttagagcaggccctgatccaataggactgtccttattagaagaggaaacttggacacagatacacacagagggagcaccgtgtgaagacacagagaggagatggccagctaccagccaagcagagagcccttactgtaaaccaaccctgccgcatcctgatctcagaattttggcttccagaactgtaaggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacgtactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggaccttctcctggcagctgcctatgttttggatgcccagtacaacagaaatgttccatttgaaactcacctcaggccatcagacgttactatttttataaccactagacaacgcaggttgccgcatacttctttatttgtgtagacctcgctcttgccctgtttgaagagtctgagttgcttcccctgcctttcttggccacctcaatagcagaagtactctgcctgactgcatactttggcagactggtacattttgcaaaagtcactcctcaaatggttttctggaaggatacaaaagacatctgcaccatggtaaccacagtggcgagtgttcattgtagtacctgtaagagtttatgaccgaaggcaggagccatgaagaaaaaagactcaatagatttgcttttgatgaaacaacaacacttccatacagtgaacgccataagcacaactgcaagcaaaccgcaaactgaagaacaaatagggcaaaatgtggcagtgcagacatttcagcatatcaagagcacttccaaattacaggaaaaaaaagatatctcaatagataattttgctgaagataagtgaaggcaactcataaggaaaaaatatgtaaaatggccgataggaaagatgtttaacgtcactaattaaaaattatagaataaaacgacaataaaataccatgtgtttgcctata

SEQ ID NO: 415213 - DNA, 3240 bp, Homo sapiens
  misc_feature (2405)..(2405): n is a, c, g, or t
  misc_feature (2446)..(2446): n is a, c, g, or t
  misc_feature (2712)..(2712): n is a, c, g, or t
taaagaggtaatccaagtaaaatgaggtccttagagcaggccctgatccaataggactgtccttattagaagaggaaacttggacacagatacacacagagggagcaccgtgtgaagacacagagaggagatggccagctaccagccaagcagagagcccttactgtaaaccaaccctgccgcatcctgatctcagaattttggcttccagaactgtaaggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacgtactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgagaccttctgccagaaagtgggcctgttgtgcacgcttcagggcaagctgcagcccgaggactggacattgttggacgaactgctgcagggcctgcaaacactgctgctcatgattttgtggcaggcttcccgtggcctcttcctgcactaccangtggaggccctaaccctgcgtcgcatcagtagcttccgccngtacaagtatgacctggtggcagcgggcaaggctttggagggcatgttctgcaagctcaaccacctcctggaacacccgcaccagctgttcttcctctacctgctccccactctgtcccgcttcgtctccatcggcctctacatgcccgccaccagcttcttgctcctggtccttggtttcaaggctctgcaactgtggatgcagctgcatgaggccggagtgggccttgaggagctcaggggggtccctgaccctagtgtccccnctcccccagcacaggatggtaagcacacaggtcccagacaggggctggatggctctgaagctggtagccctgatctacctaatactgcagctgggctgcatcgccctcaccaacttctgactggacttcctgctggccgccactatggtgctgccgctgtgctcgccgagcctttgggccctggaccctctgtgctgccctgctggtgttgacaagcccggcagccacgctccttggcagcccattcctgtggcgggagctgcaggaggcaccactgtcactggccaagggctggcagctcttcctggcagcactggcccagggtgcgctggagcaccacacctaaggcgccctgctcttcccactgctgtccctgggcctctgcccttgctgactacttttctggaatgtgctcttctggaagtgagatctgcctgtccggggcaccaggctgggacagagactccccaaggaccccattctgcctccttctggggaaataaacaagtgcctgtttcagctgcttta

SEQ ID NO: 415214 - DNA, 2299 bp, Homo sapiens
ggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaatggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415215 - DNA, 4610 bp, Homo sapiens
taaagaggtaatccaagtaaaatgaggtccttagagcaggccctgatccaataggactgtccttattagaagaggaaacttggacacagatacacacagagggagcaccgtgtgaagacacagagaggagatggccagctaccagccaagcagagagcccttactgtaaaccaaccctgccgcatcctgatctcagaattttggcttccagaactgtaaggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacgtactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgagatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415216 - DNA, 4807 bp, Homo sapiens
taaagaggtaatccaagtaaaatgaggtccttagagcaggccctgatccaataggactgtccttattagaagaggaaacttggacacagatacacacagagggagcaccgtgtgaagacacagagaggagatggccagctaccagccaagcagagagcccttactgtaaaccaaccctgccgcatcctgatctcagaattttggcttccagaactgtaaggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacgtactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggaccttctcctggcagctgcctatgttttggatgcccagtacaacagaaatgttccatttgaaactcacctcaggccatcagacgttactatttttataaccactagacaacgcaggttgccgcatacttctttatttgtgtagacctcgctcttgccctgtttgaagagtctgagttgcttcccctgcctttcttgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415217 - DNA, 2404 bp, Homo sapiens
ggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggaaaaaaaaaaaaaaaaaaaaaaaaaaaaaaaaaaaaaaaaaaaaaaaaaaaaaagggggggggggtaaaaatattcggggggggccaccaattttttagcactcacccgttttgttgtaaaaaggggggccccaataaggaggacgtatataaaaacagagagacgggggcgtcgttaaaacagtgtggcgagtggaacgaagtgctttgtggcttctttggagaagaccatcttgtgtgggtgccaatatttggacccacccacagagaattacgccggggcaactaaactctgtgttggggtgaacgacccgtatgtcgcggtggagagtgggtcgctaattagag

SEQ ID NO: 415218 - DNA, 1560 bp, Homo sapiens
ccctgggtcaggaatccaagaccccacctcttaaggacggttcctcagaaagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415219 - DNA, 1644 bp, Homo sapiens
ccctgtccctttccctctcccctcctgggacagactccaggggaggaagcgctgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415220 - DNA, 1293 bp, Homo sapiens
gtcaggagttcaagaccagcctggccaacgtggtgaaagcctgtatctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415221 - DNA, 2190 bp, Homo sapiens
ggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggcgcatctctgtcacacccggggagaagatcatcctgaacttcacgtccctggacctgtaccgcagccgcctgtgctggtacgactatgtggaggtccgagatggcttctggaggaaggcgcccctccgaggccgcctctgcgggtccaaactccctgagcctatcgtctccactgacagccgcctctgggttgtattccgcagcagcagcaattgggttggaaagggcttctttgcagtctacgaagccatctgcgggggtgatgtgaaaaaggactatggccacattcaatcgcccaactacccagacgatagccggcccagcaaagtctgcatcagcggtgc

SEQ ID NO: 415222 - DNA, 3048 bp, Homo sapiens
taaagaggtaatccaagtaaaatgaggtccttagagcaggccctgatccaataggactgtccttattagaagaggaaacttggacacagatacacacagagggagcaccgtgtgaagacacagagaggagatggccagctaccagccaagcagagagcccttactgtaaaccaaccctgccgcatcctgatctcagaattttggcttccagaactgtaaggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacgtactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgagacgttactatttttataaccactagacaacgcaggttgccgcatacttctttatttgtgtagacctcgctcttgccctgtttgaagagtctgagttgcttcccctgcctttcttggccacctcaatagcagaagtactctgcctgactgcatactttggcagactggtacattttgcaaaagtcactcctcaaatggttttctggaaggatacaaaagacatctgcaccatggtaaccacagtggcgagtgttcattgtagtacctgtaagagtttatgaccgaaggcaggagccatgaagaaaaaagactcaatagatttgcttttgatgaaacaacaacacttccatacagtgaacgccataagcacaactgcaagcaaaccgcaaactgaagaacaaatagggcaaaatgtggcagtgcagacatttcagcatatcaagagcacttccaaattacaggaaaaaaaagatatctcaatagataattttgctgaagataagtgaaggcaactcataaggaaaaaatatgtaaaatggccgataggaaagatgtttaacgtcactaattaaaaattatagaataaaacgacaataaaataccatgtgtttgcctata

SEQ ID NO: 415223 - DNA, 785 bp, Homo sapiens
ggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtatacccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415224 - DNA, 3319 bp, Homo sapiens
taaagaggtaatccaagtaaaatgaggtccttagagcaggccctgatccaataggactgtccttattagaagaggaaacttggacacagatacacacagagggagcaccgtgtgaagacacagagaggagatggccagctaccagccaagcagagagcccttactgtaaaccaaccctgccgcatcctgatctcagaattttggcttccagaactgtaaggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacgtactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggaccttctcctggcagctgcctatgttttggatgcccagtacaacagaaatgttccatttgaaactcacctcaggccatcagacgttactatttttataaccactagacaacgcaggttgccgcatacttctttatttgtgtagacctcgctcttgccctgtttgaagagtctgagttgcttcccctgcctttcttgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaaggga

SEQ ID NO: 415225 - DNA, 3412 bp, Homo sapiens
taaagaggtaatccaagtaaaatgaggtccttagagcaggccctgatccaataggactgtccttattagaagaggaaacttggacacagatacacacagagggagcaccgtgtgaagacacagagaggagatggccagctaccagccaagcagagagcccttactgtaaaccaaccctgccgcatcctgatctcagaattttggcttccagaactgtaaggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacgtactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggaccttctcctggcagctgcctatgttttggatgcccagtacaacagaaatgttccatttgaaactcacctcaggccatcagacgttactatttttataaccactagacaacgcaggttgccgcatacttctttatttgtgtagacctcgctcttgccctgtttgaagagtctgagttgcttcccctgcctttcttggccacctcaatagcagaagtactctgcctgactgcatactttggcagactggtacattttgcaaaagtcactcctcaaatggttttctggaaggatacaaaagacatctgcaccatggtaaccacagtggcgagtgttcattgtagtacctgtaagagtttatgaccgaaggcaggagccatgaagaaaaaagactcaatagatttgcttttgatgaaacaacaacacttccatacagtgaacgccataagcacaactgcaagcaaaccgcaaactgaagaacaaatagggcaaaatgtggcagtgcagacatttcagcatatcaagagcacttccaaattacaggaaaaaaaagatatctcaatagataattttgctgaagataagtgaaggcaactcataaggaaaaaatatgtaaaatggccgataggaaagatgtttaacgtcactaattaaaaattatagaataaaacgacaataaaataccatgtgtttgcctataaaacaatcttagcaagattgaaaacaaactttttgtaatttccaatttttagtttagattcaggtggtacatgtgcaggtttgttacatgggtatatttcgtgatggtgaggtttggggtacaactgatcccatcactcaggtagtgagcctagaatccagcaggtagtttttcaacccttcccctcctctgtcccttcccctcaggaatccccagtgtctactgttgccatctttgtgtccatgagtacccagtgtttagctcctacttataagtgacaac

SEQ ID NO: 415226 - DNA, 1842 bp, Homo sapiens
  misc_feature (1007)..(1007): n is a, c, g, or t
  misc_feature (1048)..(1048): n is a, c, g, or t
  misc_feature (1314)..(1314): n is a, c, g, or t
cccgggtcttacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagtgggcctgttgtgcacgcttcagggcaagctgcagcccgaggactggacattgttggacgaactgctgcagggcctgcaaacactgctgctcatgattttgtggcaggcttcccgtggcctcttcctgcactaccangtggaggccctaaccctgcgtcgcatcagtagcttccgccngtacaagtatgacctggtggcagcgggcaaggctttggagggcatgttctgcaagctcaaccacctcctggaacacccgcaccagctgttcttcctctacctgctccccactctgtcccgcttcgtctccatcggcctctacatgcccgccaccagcttcttgctcctggtccttggtttcaaggctctgcaactgtggatgcagctgcatgaggccggagtgggccttgaggagctcaggggggtccctgaccctagtgtccccnctcccccagcacaggatggtaagcacacaggtcccagacaggggctggatggctctgaagctggtagccctgatctacctaatactgcagctgggctgcatcgccctcaccaacttctgactggacttcctgctggccgccactatggtgctgccgctgtgctcgccgagcctttgggccctggaccctctgtgctgccctgctggtgttgacaagcccggcagccacgctccttggcagcccattcctgtggcgggagctgcaggaggcaccactgtcactggccaagggctggcagctcttcctggcagcactggcccagggtgcgctggagcaccacacctaaggcgccctgctcttcccactgctgtccctgggcctctgcccttgctgactacttttctggaatgtgctcttctggaagtgagatctgcctgtccggggcaccaggctgggacagagactccccaaggaccccattctgcctccttctggggaaataaacaagtgcctgtttcagctgcttta

SEQ ID NO: 415227 - DNA, 1907 bp, Homo sapiens
  misc_feature (1007)..(1007): n is a, c, g, or t
  misc_feature (1048)..(1048): n is a, c, g, or t
  misc_feature (1314)..(1314): n is a, c, g, or t
cccgggtcttacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagtgggcctgttgtgcacgcttcagggcaagctgcagcccgaggactggacattgttggacgaactgctgcagggcctgcaaacactgctgctcatgattttgtggcaggcttcccgtggcctcttcctgcactaccangtggaggccctaaccctgcgtcgcatcagtagcttccgccngtacaagtatgacctggtggcagcgggcaaggctttggagggcatgttctgcaagctcaaccacctcctggaacacccgcaccagctgttcttcctctacctgctccccactctgtcccgcttcgtctccatcggcctctacatgcccgccaccagcttcttgctcctggtccttggtttcaaggctctgcaactgtggatgcagctgcatgaggccggagtgggccttgaggagctcaggggggtccctgaccctagtgtccccnctcccccagcacaggatggtaagcacacaggtcccagacaggggctggatggctctgaagctggtagccctgatctacctaatactgcagctgggctgcatcgccctcaccaacttctgactggacttcctgctggccgccactatggtgctgccgctgtgctcgccgagcctttgggccctggaccctctgtgctgccctgctggtgttgacaagcccggcagccacgctccttggcagcccattcctgtggcgggagctgcaggaggcaccactgtcactggccaagggctggcagctcttcctggcagcactggcccagggtgcgctggagcaccacacctaaggcgccctgctcttcccactgctgtccctgggcctctgcccttgctgactacttttctggaatgtgctcttctggaagtgagatctgcctgtccggggcaccaggctgggacagagactccccaaggaccccattctgcctccttctggggaaataaacaagtgcctgtttcagctgctttaaaaaaaaatagaaaaaaaaaatgccctggaaaatactgtgttagcaaaaagatttaaagattggt

SEQ ID NO: 415228 - DNA, 484 bp, Homo sapiens
agagtgagctggtaccgatattgaagagtgtggacaggtatgatatcatcacggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttgcaacctgataccttgaaaagcttctatgtgtctctccttttgttgcctggcagctgtctaggatgatcactgattactatttactaagtagccacatgcaaataaaagttgtttggtaaaatgga

SEQ ID NO: 415229 - DNA, 498 bp, Homo sapiens
caggggttgctgccctcaggccacgcaggaggcgaggaggcagggtcatgcgtggcctcctgggcagtggggctgagggtacctgaggggtgggcaggagctggcgctgctgtctctaacagtcactctccacctccttccagttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctca

SEQ ID NO: 415230 - DNA, 269 bp, Homo sapiens
ggccccactaggagcccacactacgctctcctggggggtcccctaggacggggagggaactaataattactgggccctccccagcggcagccgtggctcctacattagctggtttaattctccaaacaggtcttggaggaaggcatccttctattctactgatcagaaagctggacaaagtcccactgccaggctacacagttggtgccatttgcggaggtgacctttgacctttaacccacgcggccacccgcccgagctcttacccc

SEQ ID NO: 415231 - DNA, 2549 bp, Homo sapiens
ggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccctcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttattgggactgaga

SEQ ID NO: 415232 - DNA, 1412 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415233 - DNA, 1474 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtggaaaaaaaaaaaaaagacaaagaagtataacaaacaagagcacacaagaacagacgaggggggg

SEQ ID NO: 415234 - DNA, 1425 bp, Homo sapiens
aatcatgcgaaccgtttcgtgaacgccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtggaaaaaaaaaaaaaagacaaagaagtataacaaacaagagcacacaagaacagacgaggggggg

SEQ ID NO: 415235 - DNA, 1482 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtggaaccgaggctctgcaggaatgcagggagggccgggctccgccccagggttatttctaagttgaaaacagga

SEQ ID NO: 415236 - DNA, 2453 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtggaaacaaaaagaaacaaccaccaaaaaaaaacaaaaaaaaaaaaaaaaacaaacacaaaaaaaaaaacaacaacaaacaacgaccacaagggcgggggggagctagccacaagagatactcccaggcgggggggcgcacacagagagaagctcacaccacaccaccctatctgcgagcacaagagagcgggagcgcacaaaaagacgcgcccagcgtcacaagagcaccacagcggaccgcacgccccgtctatacaaacacgcgtcacctgatggcgtgggcaacaactcagcacgcacggagtgggcgaccgccctctaccgtcattgccggatcacaccactagccactacttattaatgttgtgagggggagaaggacaattatgatgatagagacgacaatctaagtcctgaagaagacactatcaagagtacggctgtatcgcgctgtcagttactactatttcaacctcccccctacctcctcacctttactaattactcagcacctgtaccaaaccaaaaccaccacgccacaccaatcaacactctatcttcactccatccacacacaaccgacacaaaacataactgccactaccctctacacatcacacccaacctcactatttagtcctgttcctccacaacatactaacaatttactcaccaattctccaccccacatacctacgaactccatcatccatcactcacaacgtttccagcctcagcacaatcccatagcacacagagccaccaccaggacgtcacacccactcagacccgacgccacagaacacgctaggagaatcgcagagagtagatcacgcacgcacggcgccgacccccaccaaagcagatcacaacggccagcagcacgtaccaccgtacttcacacgctcccgaccgagagcacgagcgacacgcctagccaataacccagcctccgcgaacagcagctcagcacccagagtcaccccgcgcacaccatgccaagagaacacccacacggccatcacagacaaggcagcgtcact

SEQ ID NO: 415237 - DNA, 1876 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcatggcaggccggggcggggcatgtctgcgtgttctgtctggatggggtatgggaccgtctgttcattatgaagtgggctcagagctgtgattctgtgagcatgtgtgcatgcatgcatgtgacctcattgtccagtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415238 - DNA, 1395 bp, Homo sapiens
  misc_feature (137)..(137): n is a, c, g, or t
gtcgatctccaggatctccgggagccgctgtgccaccgtgcttgaaaaaatgctgccggtaacttcctttacttttatccgggcacacagaagcatcgccgctcatctcctgaatcaaacccctgctggggctctcnggtctggtgcagagccacgcaggtcgctgtgggcgggctccaggcgcagtaggggtcccgcgccagcacacagtcctcgcaggtgccgtgcttcccacagaaggccagcggggcctggaccacgcccgagttagagccagcatagacaaacctgttgcccttctttgaagacagcagcagggtctggactggctcaaagtcctggaagtgctgggtctcctcgatgatgtgaacaagcgggctcccggccgggagcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415239 - DNA, 1374 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415240 - DNA, 2168 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcatggcaggccggggcggggcatgtctgcgtgttctgtctggatggggtatgggaccgtctgttcattatgaagtgggctcagagctgtgattctgtgagcatgtgtgcatgcatgcatgtgacctcattgtccagtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtacagccgcggggtccccggggctgggcggggtcgagcggggcgcaccacgggttcgctctgtctaggccatagcttggcagtgccggggcgggggctctcagcctggcaggagaggcaggaccctcacgggggaaaggggctggacgcgcctggccgcggtgtggggctggcacgggggcggaaggaaagcggcgatgccccccacttcctcggaccaggggtgcccatctgagtccctgggggcaggggcgccctcgggctttgacgacgccccgtcccgctgggccaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415241 - DNA, 1666 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggaaagacgacgtcacaggctacttcccgtccatgtacctgcaaaagtcagggcaagacgtgtcccaggcccaacgccagatcaagcggggggcgccgccccgcaggtacagccgcggggtccccggggctgggcggggtcgagcggggcgcaccacgggttcgctctgtctaggccatagcttggcagtgccggggcgggggctctcagcctggcaggagaggcaggaccctcacgggggaaaggggctggacgcgcctggccgcggtgtggggctggcacgggggcggaaggaaagcggcgatgccccccacttcctcggaccaggggtgcccatctgagtccctgggggcaggggcgccctcgggctttgacgacgccccgtcccgctgggccaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415242 - DNA, 1556 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcatggcaggccggggcggggcatgtctgcgtgttctgtctggatggggtatgggaccgtctgttcattatgaagtgggctcagagctgtgattctgtgagcatgtgtgcatgcatgcatgtgacctcattgtccagtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcgtccttcctcgagcccctggacagtcctgacgagacggaagaccctgagcccaactatgcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415243 - DNA, 1359 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtacagccgcggggtccccggggaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtggaaccgaggctctgcaggaatgcagggagggccgggctccgccccagggttatttctaagttgaaaacagga

SEQ ID NO: 415244 - DNA, 1344 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcatggcaggccggggcggggcatgtctgcgtgttctgtctggatggggtatgggaccgtctgttcattatgaagtgggctcagagctgtgattctgtgagcatgtgtgcatgcatgcatgtgacctcattgtccagtgtggtgaaggtgacatttccaaatctgagcaggggacgaggtgtccctgctcgagggtgaagctgttgaggtcattcacaagctcctggacggctggtgggtcatcaggtaggagggcccctctccatccagagcacccatctgagtcagccccagccaggacggggtgtttagggatctggggtgacttgtccctgggactctgggtaagccactgcccctctctgggcttagtttccatctcagtagcagggaggaatgagcccacccttgcctgtcttgtggggatccaatgtccttgtccaagtgggtgcatttctcctttgtgatttagggtctcttcccaaccatctatta

SEQ ID NO: 415245 - DNA, 1092 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415246 - DNA, 1166 bp, Homo sapiens
cagtccaggggggctccccggagagggggacgacagaccgaaggctggtgaggggcgtggaaaaccgaccgtgccctgcccattcttgccaatgtcttatagcaaatacctgtcccctgcggtgacctggatctgctaacctccacccctgcctagactgtggaaggattgctggaagggtctcagttgcacagaccaggaaactgaggcccacagaggcaggtgtccggttgtttgcaacctctcagcctgtgctaaccccaattgttcagagagagccctgaaaccctctcctctgggcgcccccaggtgactgccccagcctcaagggctgcctctgttgcaggaaagacgacgtcacaggctacttcccgtccatgtacctgcaaaagtcagggcaagacgtgtcccaggcccaacgccagatcaagcggggggcgccgccccgcaggtacagccgcggggtccccggggctgggcggggtcgagcggggcgcaccacgggttcgctctgtctaggccatagcttggcagtgccggggcgggggctctcagcctggcaggagaggcaggaccctcacgggggaaaggggctggacgcgcctggccgcggtgtggggctggcacgggggcggaaggaaagcggcgatgccccccacttcctcggaccaggggtgcccatctgagtccctgggggcaggggcgccctcgggctttgacgacgccccgtcccgctgggccaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 415247 - DNA, 598 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagggcagccccgacccctgtccagcgcggctcccgccaccctcaataaatgttgcttggagtgga

SEQ ID NO: 415248 - DNA, 739 bp, Homo sapiens
gaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaggggtaaggctgcctgagccttggcagggggcttgtggctgtgggttcctgagcaccaggggaaggag

SEQ ID NO: 415249 - DNA, 3309 bp, Homo sapiens
  misc_feature (3309)..(3309): n is a, c, g, or t
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcn

SEQ ID NO: 415250 - DNA, 1931 bp, Homo sapiens
gggaccttgtggggtgagtctggctttttggcggcaactccctggccaagtgtgagcacctggaagcaaaaggatggggcaggactccagcgctcgcgggtgctctctggtggccacggggagaagaggctttgggcggcggcgggtgccaaggtcagggcagagtgggggctggacccccacggggctttggacggcacagatctgaagtggagccggcaggccttgctggggctggactttggggaggaggcctctagtggggccaggtgtggtgggggagtagggtggccgctgtctgtgttaccagtggaccttgagctccaagactgcctggcccgcctaagctggtccattggggcccaatgcataaccctggctctgagcctcaatcctgtccacataaaggagtggagcccggtccccctccagggaggggaaagaactcgtgtccagggatccacgccatggcagacgtgggctcttggggtagcaggagccgccttatgggggaatagggctcagctggtgacaccttctgcccacaggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatgatgtggcctagcggaagctgcctcctcaccctaggtgttgctggagaaccctgagggcagggcccgagccccgacacatcccttcccccaaaaagcaacacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaagaaccaagta

SEQ ID NO: 415251 - DNA, 4419 bp, Homo sapiens
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatgatgtggcctagcggaagctgcctcctcaccctaggtgttgctggagaaccctgagggcagggcccgagccccgacacatcccttcccccaaaaagcaacacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaagaaccaagta

SEQ ID NO: 415252 - DNA, 3577 bp, Homo sapiens
  misc_feature (3309)..(3309): n is a, c, g, or t
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcnaggggtccacgtcagcgtttgggatgggggattctggagccatacaaagcaacccagagagtcctgggccggccacacccgagagtccctcccacctggtttcttcctggaagctgggtctctcccctaccctgcacggggttggtttcattggtggcagcagcagccatgagtggcccctccccccagtcccaccaaagagccgtgcaagcagacaggtcacactttcagcagatgagcttgaacctcaggagggttgtggcacaat

SEQ ID NO: 415253 - DNA, 3277 bp, Homo sapiens
  misc_feature (3277)..(3277): n is a, c, g, or t
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcn

SEQ ID NO: 415254 - DNA, 3234 bp, Homo sapiens
  misc_feature (3234)..(3234): n is a, c, g, or t
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcn

SEQ ID NO: 415255 - DNA, 3502 bp, Homo sapiens
  misc_feature (3234)..(3234): n is a, c, g, or t
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcnaggggtccacgtcagcgtttgggatgggggattctggagccatacaaagcaacccagagagtcctgggccggccacacccgagagtccctcccacctggtttcttcctggaagctgggtctctcccctaccctgcacggggttggtttcattggtggcagcagcagccatgagtggcccctccccccagtcccaccaaagagccgtgcaagcagacaggtcacactttcagcagatgagcttgaacctcaggagggttgtggcacaat

SEQ ID NO: 415256 - DNA, 3387 bp, Homo sapiens
  misc_feature (3119)..(3119): n is a, c, g, or t
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtcgcaccggagcagcggctggattgaacgccccagattggggcccgagatgtggccctcggtttcctttcataaaggagttgtgtccccagcccttccactccagtaaagaactgaattggcnaggggtccacgtcagcgtttgggatgggggattctggagccatacaaagcaacccagagagtcctgggccggccacacccgagagtccctcccacctggtttcttcctggaagctgggtctctcccctaccctgcacggggttggtttcattggtggcagcagcagccatgagtggcccctccccccagtcccaccaaagagccgtgcaagcagacaggtcacactttcagcagatgagcttgaacctcaggagggttgtggcacaat

SEQ ID NO: 415257 - DNA, 3397 bp, Homo sapiens
  misc_feature (3397)..(3397): n is a, c, g, or t
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggagggtaaggcccggcagcttgggaggcaggtggcgcaggtggggtcccggccgaggtcgcggcgctgaccctttgtctctcgtcgccgcagtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcn

SEQ ID NO: 415258 - DNA, 3386 bp, Homo sapiens
  misc_feature (3386)..(3386): n is a, c, g, or t
atttaaaaatatatgttaatctcaaagctaagattacagatttaactccttccaatctccttttccataggttataaaaagagttatttgattaaaaggtgggtcactatgaccagacgctcttctttactagttggaagctgatcatagatacacccacctcccttacataatttgtagcattccaccttcatggaagaaagcattcagaactctgctaccagatacacagcccaggaaacattatttattattctgtacacttatattccacaaagagaacaacttttaaaatccatatcagacacagaaatctgcatgacattggaacagtccatgacacagagaggacacaattgaaacagtctttatttacacggaagcagagagacagagggatgagggcaggcaccccaaaagtgacttcacattcaccaatgtttcagtggcttctaagaccacagcagagctgtggatcctgggactcacagggtatgaaaatgtgttaccctccaaagcctcaaaacaaaagggttggattaaaaacaaataccaagtgtttctggcatcagttgaaaaatatctgagaaagaggaactattgaatgtccagaaaaatcaaagttctggaggctagaaatctgacatttctctgatagagagatcactggtcatcagttcattttgggaaattcttacagttaagtgatgtgtttccttcattgtaaatttaacaggagagcatcattatggatacaagcagggttttctttaatggaatgggaactttgatgatctgatataacccctgattttaaagacaaagaatcttgaagccccaaaagatgaagccactatccccaggccacccagctagtcagctgcagacccaagtctgtaaaactatatgctgtgctttttccgccacactacacaccttctctgtttttctctcttcggtggctttcgaaggaaataaacaaataaagtgagttcaatgggcttctttactaggaaatgatttctttggtaagaatgcttcagtctcacattagcgaggctagaaaacagatcatatagcaggaactggctcccagctgagcggtaactccttttgagaattaaggcagcttcagggatttctgttcagcaggatatctggcaagagttggtagctctccttctcccttgtctcgttttcatctagaatgaaagctaaaaggtgggtgctaaataactagacattgagtagacgtaaatgtgatgttctcaaactgatattttacatttcatgaaaaataataattctttaaaaacctgaaaaaatatcaaaagcgtcaagtgtcatatacagtacacagcacccttgtcccgggtgacctctgctattaaaaacaagctacaaaaaggaagtcaaagatgacttaacataaagcccatactctctctccattaaatgtgggtggaaaggtaaacccaaatgatctccaagcacctccccgagaacttccaagggctttctgggtacccccaccctcccaggggacccaggcttggagccaggttcccatcccagattcaggagccaacttccgccgcaaggcagcaccactgcgttggtttggtgttggttcagctagcaccacatctccgattcaccccgggacaaatgtctggaggcagaaggggccacatgcagatggcaaagaggacgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgaggtgaggcccagggcagggggacccccgggctccaccagtcccaacggtgggctgacgcttcttcctcgtcccctcagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcn

SEQ ID NO: 415259 - DNA, 1006 bp, Homo sapiens
  misc_feature (1006)..(1006): n is a, c, g, or t
tgaacaccatcaagcgctgcctcctcatcgactacaaccccgactcaacagctttggcccccatggtatgcatgtgaagctcatggccaccatgttccagaacctttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcn

SEQ ID NO: 415260 - DNA, 931 bp, Homo sapiens
  misc_feature (931)..(931): n is a, c, g, or t
tgaacaccatcaagcgctgcctcctcatcgactacaaccccgactcaacagctttggcccccatggtatgcatgtgaagctcatggccaccatgttccagaacctttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcn

SEQ ID NO: 415261 - DNA, 305 bp, Homo sapiens
  misc_feature (10)..(10): n is a, c, g, or t
  misc_feature (12)..(14): n is a, c, g, or t
gcctgggccnannncataaacaaacagtactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgcttta

SEQ ID NO: 415262 - DNA, 340 bp, Homo sapiens
  misc_feature (36)..(37): n is a, c, g, or t
gggagcgccgccctggcccgccgggcccgttttttnnggctgttgcggcataaaaaccaacctactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgcttta

SEQ ID NO: 415263 - DNA, 303 bp, Homo sapiens
ctttttctttttttaaacagcctaaaactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgcttta

SEQ ID NO: 415264 - DNA, 847 bp, Homo sapiens
  misc_feature (40)..(41): n is a, c, g, or t
  misc_feature (69)..(69): n is a, c, g, or t
ctggggacaccagcccggtggactctttcccggccccccnncacacatttcagcggcactgactctctngttgaaccggcgcaacagggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggtatttttcctattttgtcataattgtaatca

SEQ ID NO: 415265 - DNA, 505 bp, Homo sapiens
gaggaaaagcaacactttctgcaaggggaggacataagaaaagtgtagggagaaaagcaaggcccaggaaaatgtttgagagaagacatttcttcaaaataataatgtaagatgttaaaaattagagtttgtttaattaaattaatactgagttgctttgattatattaggctctttattatttcatttttatcctgaagtgttggagatggttaaataaataccaaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggtacatgtacaagcttttctttcaacattagcatggcatgtaaactccctaagtacaagatttatattgagctttatttctcctataggatgtatcactatcctgcacaaa

SEQ ID NO: 415266 - DNA, 2772 bp, Homo sapiens
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgcttta

SEQ ID NO: 415267 - DNA, 3083 bp, Homo sapiens
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgctttaaattttggagctttcataaatgttcaatgcattttaagtgtgtggcttataaatattttggtatttttctatactacgtaaattctgagtttaaatgtcatacacaaatactaagacactttgcatttttaaaaattaagaatcatttgtgaagtccactacgaggtacttcaaaagcccagtaatggtggtcagataccatgtagatggatacagattgttgactcttttgaagttgtttttttcttatattttatattaccattaaccaataaaatctggcagaaagtctgctattccattggtaaagt

SEQ ID NO: 415268 - DNA, 2693 bp, Homo sapiens
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgt

SEQ ID NO: 415269 - DNA, 2590 bp, Homo sapiens
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgcttta

SEQ ID NO: 415270 - DNA, 3011 bp, Homo sapiens
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaattctaagattgattcactgacggaatctattgcacaacttgagaaagatgtcagcaacttaaataaagaaaagtcagctttacttggcattagatttagaacaacttctaaatcatcgtgaggaattggcagcaatgaaacagattctcgttaagatgcatagtaaacattctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaaaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgctttaaattttggagctttcataaatgttcaatgcattttaagtgtgtggcttataaatattttggtatttttctatactacgtaaattctgagtttaaatgtcatacacaaatactaagacactttgcatttttaaaaattaagaatcatttgtgaagtccactacgaggtacttcaaaagcccagtaatggtggtcagataccatgtagatggatacagattgttgactcttttgaagttgtttttttcttatattttatattaccattaaccaataaaatctggcagaaagtctgctattccattggtaaagt

SEQ ID NO: 415271 - DNA, 2286 bp, Homo sapiens
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcaggtaaaccatctacaaatcttttatttgaataataaagacattgttaccat

SEQ ID NO: 415272 - DNA, 2473 bp, Homo sapiens
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgcttta

SEQ ID NO: 415273 - DNA, 1949 bp, Homo sapiens
  misc_feature (1892)..(1892): n is a, c, g, or t
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactgggctctttttctacggtatgngctaagttcacaacgccaaagacactaaggaagtgtacctggcggagagtgtcaatt

SEQ ID NO: 415274 - DNA, 1871 bp, Homo sapiens
catccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggtacatgtacaagcttttctttcaacattagcatggcatgtaaactccctaagtacaagatttatattgagctttatttctcctataggatgtatcactatcctgcacaaa

SEQ ID NO: 415275 - DNA, 1406 bp, Homo sapiens
gaggaaaagcaacactttctgcaaggggaggacataagaaaagtgtagggagaaaagcaaggcccaggaaaatgtttgagagaagacatttcttcaaaataataatgtaagatgttaaaaattagagtttgtttaattaaattaatactgagttgctttgattatattaggctctttattatttcatttttatcctgaagtgttggagatggttaaataaataccaaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgcttta

SEQ ID NO: 415276 - DNA, 1083 bp, Homo sapiens
taccatggctggccaatagatttagataggtatgggaaggatcgttgcacctcgttttgtatatgtaaagggatgcgtagggatgggagggcgatgaggactaggatgatggcggacaggatagttcagacggtttctatttcctgagcgtctgagatgttagtattagttagttttgttgtgagtgtcaggaaaagggcatacaggactaggaagcagatattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgcttta

SEQ ID NO: 415277 - DNA, 614 bp, Homo sapiens
ctttttctttttttaaacagcctaaaactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgctttaaattttggagctttcataaatgttcaatgcattttaagtgtgtggcttataaatattttggtatttttctatactacgtaaattctgagtttaaatgtcatacacaaatactaagacactttgcatttttaaaaattaagaatcatttgtgaagtccactacgaggtacttcaaaagcccagtaatggtggtcagataccatgtagatggatacagattgttgactcttttgaagttgtttttttcttatattttatattaccattaaccaataaaatctggcagaaagtctgctattccattggtaaagt

SEQ ID NO: 415278 - DNA, 429 bp, Homo sapiens
tgatatgttccagaagtttacaagcacctagtgtggagtgagcagtagtagatgagtagtaatggagtgtcagtagaagggaggaaatactgtcaaaggtaagaggttataaatcatctggcccttgagggaagttaattgaacattaaggcttgatagaaagtattagtggctagggtccattaatgactgtcttgttgtagttttgtaaatatttatctttattactgataagtgagagcactacaaattacaaattttaattgtaatttggatttaagactgcttattaatttaatttttttcaaggttcgcttctatgagctagtgaatccattaagaaaggaaatctgtgaactacaagtgaaaaagaatatcctagcagaagaattaagtacaaacaaaaaccaactgaagcagctgacagag

SEQ ID NO: 415279 - DNA, 1229 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaa

SEQ ID NO: 415280 - DNA, 1168 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggagagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaa

SEQ ID NO: 415281 - DNA, 1125 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggaggaagatcagcccatctacttggcagtgaagggagtggtgtttgatgtcacctccggaaaggacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaa

SEQ ID NO: 415282 - DNA, 1470 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaagagcaaatgcctcctgttgtccttggtcaggggttctgtctacctggggacccctgtctgcacaccagggatcaataagagccaaagtgggacacctcctagatgtcagtatcagctggctgggcagtggaattttgagcgacctttactttatacttttctgtgcttgacagattttcagccatgaccatgttcactttataatcaaaacaaaaataaaggtcccatttttacaaaagga

SEQ ID NO: 415283 - DNA, 1650 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggagagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaaaaaaaaaaaaaaaaaaaaaaaaaaaaaaaaacaaaaaaaaaaaaaaaacaaaaaaaaaatagagtgtgtgtggggcgcgcgcgcgcgcgcgcgccccgcagaaaaaagcttttaagcaacacccgcgcgtgggggagcgagcgcgggcgcccacaaggagagaagagacaagagcggtgggcaaaagaggggtgtccccaggagagagaacagcggcggagacaaagaaaaagagggcggggagccttcccaccaaaataaaaaaagaagcggcgcggggggagacccaaacagacgagctggtttctaggagagagacaaaatcacacagagggagagaggagatagcgagagagagagcgatagcaaagagagggagagaatctaatacaaccgagaaggaggagctgctaacaaggaaagccgtagccaaaaagtctataaaaatattagcccccgaggacgggggggggggggggggc

SEQ ID NO: 415284 - DNA, 1079 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggagagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggaagcccagggggtttttccccttttttt

SEQ ID NO: 415285 - DNA, 929 bp, Homo sapiens
gaaccaaagaacagatacctagtaaaatagaagacctagggttcccacaacagacgggatgtacacagcacccaaccgagcgggtgcccaatgcggttatcccgaggagagtggacccataggagggaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaaaaaaaaaaatatcaccatctcaagcagctatgatgttaaacaagtggcactgagttccggtgtttctaaaattttgagactgcgtctcgctctgattgccagattggagtgcatggggacacccatgggtccattgaagctcgacctccgggttaaacaatctccagaatgggcaagcggatttccacttgggctccggcgtggcagaggcgtggcccagaccgtgctggctgcccctttgactctggaaccattggcacgacggcggagggtctatacgagcgagtctcggacggcgcgtcatatgccgcagctcactatcacgg

SEQ ID NO: 415286 - DNA, 522 bp, Homo sapiens
atgaagcattgctccccgtatgttataccctcccacccccacgccccccccacagcagtgtctcttaagccatttgtccattatttggtttgttgagatatcttttctcttgcattagggatgtgggaggcaaggcagggatggagaaaggccagtgccaaacactatccacttaaccccatctcctgtctttcttgggcttttctccccaagacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaa

SEQ ID NO: 415287 - DNA, 980 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggagactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaa

SEQ ID NO: 415288 - DNA, 1084 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggagggactctccaactgacccgatgatctttgggaccactggcacaagaatctaaggaaagagagagttcaccactgaggttacagcaagagtgccagaactgcaagatgaggactgagaaaagacccttggttttttgatgttgatgttatagattgaaatttaactgagagagagaggaccttgagatggaaacaggggtaggaaacaattgttttgggagtggagcctgaggatctctgtaggtggaaggaaggagccagagagaggaggggagcgagggacgagagaggcagttgagtgcagtgggttcaagctgtgctgcgctgttg

SEQ ID NO: 415289 - DNA, 684 bp, Homo sapiens
atttctcacccttccctacccaataacggtggactcacttgcctaggccgtatatacagatggtgtggttagtattgaacactgtatatgctaggcagagggtgccccatgtgaccagcccccagtgaaaaccttgggtgctgagtctaatgggcatctctagcagaggaatgttctgccagaagaatggcacatactgtcaagttttgttgctgggggaagagtgtgctcttcctcatgggagggagagagcataggaaacctgcacatagattcccctagattctccctctgtgtttttccttcccagctgtgagtagaactatatgctgggttcttggaatcttccttctagggactctccaactgacccgatgatctttgggaccactggcacaagaatctaaggaaagagagagttcaccactgaggttacagcaagagtgccagaactgcaagatgaggactgagaaaagacccttggttttttgatgttgatgttatagattgaaatttaactgagagagagaggaccttgagatggaaacaggggtaggaaacaattgttttgggagtggagcctgaggatctctgtaggtggaaggaaggagccagagagaggaggggagcgagggacgagagaggcagttgagtgcagtgggttcaagctgtgctgcgctgttg

SEQ ID NO: 415290 - DNA, 1591 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaagagcaaatgcctcctgttgtccttggtcaggggttctgtctacctggggacccctgtctgcacaccagggatcaataagagccaaagtgggacacctcctagatgtcagtatcagctggctgggcagtggaattttgagcgacctttactttatacttttctgtgcttgacagattttcagccatgaccatgttcactttataatcaaaacaaaaataaaggtcccatttttacaaaaggaaaaaaaaaacaaactcctaggggggccccggtcccaattcgccctataaggagtgtattacaagtaaatggcccgggttttacaacgttttgactgtaaaaaccctgcgttccccaaatta

SEQ ID NO: 415291 - DNA, 1711 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaaaaaaaaaaaaaaaaaaaaaaaaaaaaaaaaacaaaaaaaaaaaaaaaacaaaaaaaaaatagagtgtgtgtggggcgcgcgcgcgcgcgcgcgccccgcagaaaaaagcttttaagcaacacccgcgcgtgggggagcgagcgcgggcgcccacaaggagagaagagacaagagcggtgggcaaaagaggggtgtccccaggagagagaacagcggcggagacaaagaaaaagagggcggggagccttcccaccaaaataaaaaaagaagcggcgcggggggagacccaaacagacgagctggtttctaggagagagacaaaatcacacagagggagagaggagatagcgagagagagagcgatagcaaagagagggagagaatctaatacaaccgagaaggaggagctgctaacaaggaaagccgtagccaaaaagtctataaaaatattagcccccgaggacgggggggggggggggggc

SEQ ID NO: 415292 - DNA, 1248 bp, Homo sapiens
cgtggatctgtcttgttcagtggtgagtccccagtgacctggtacatggaggtactcaaaaatatttgttgcataaagtaatgagcaaagtttggcacaaatgttagctattattatttcagggcgtatcggtaacagcaccctaccctttgcaaaaatctccttgggaaccagaaacttaaacacaaccaggaagaaaaaaaatcagccaaaaataaaagcgaattaagacagttggggtcttattttagaaatatacctttctaggttctggtatgttgggctctgtcatctttctacctgatcaaggaaccactgtgacattttttggtaacttccagtctgtagtttggatttaggagttcaggattccaatcctaatttccaggttccagctgcgtggcccgagtagcccggccagccccaccccggggcgcaggaggcgcgcgaagggcgggagttctcgggtccccgccctcggggaggctctgggcgcggggcgggactccgggacgctgggcgggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggagcttctcccctgctttctaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaa

SEQ ID NO: 415293 - DNA, 603 bp, Homo sapiens
gaaccaaagaacagatacctagtaaaatagaagacctagggttcccacaacagacgggatgtacacagcacccaaccgagcgggtgcccaatgcggttatcccgaggagagtggacccataggagggaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaa

SEQ ID NO: 415294 - DNA, 494 bp, Homo sapiens
tgctgaggtactctagcaggatctcaacgtcagcactcttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaa

SEQ ID NO: 415295 - DNA, 174 bp, Homo sapiens
cgtgagcgtggagtcttttttaggattgggtgcgggccttgggagcgcccccacgtgcaagctcctggttactctgcatgtaaacccacgcttacgtctcttccttccttcccactacagagttttatggacgaggagccccctacaatgccttgacggggaaggactccacta

SEQ ID NO: 415296 - DNA, 2903 bp, Homo sapiens
gggtcgagtcttgaggtgggctggaggggaaggagacacagggtgctcacgctgtccccccttcctcagctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgttgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagcaaaaaaaaaaaa

SEQ ID NO: 415297 - DNA, 6066 bp, Homo sapiens
ggtatatcaggagctgagtgacttgccaggggagtgcagagctcatgggcacctggctgctgtctacatggcccttgggaaatacacaatggcattcaagtgttatgaagagcaactggatctagggcaaaagctgaaggatccgagtctggaagcccaggtctatggcaacatgggcatcacaaagatgaacatgaatgtgatggaagaagccattggctactttgagcagcaattggccatgctgcagcagctaagtggaaatgagtctgtgctcgacaggggccgggcctatggcaacctgggggattgctacgaagccctgggtgactatgaggaagctatcaaatactatgaacaatatttatctgtcgcgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacaggagctgccagagcatgacgagcctgttcagtaacactgtgtcaccgacccaggacgggacctcctctcttcccaggaggcagagctcgtttgccaagcccccgctccgtgccctgtatgacctgctcatcgcgcccatggaagggggcctgatgcactccagcggccccgtgggccggcaccggcagctcatcctggttctggagggggagctctacctcattcctttcgccctcctgaagggaagctcctccaatgagtacctctacgagcgcttcggcctccttgctgtcccttccatccgctccctcagcgtgcagtccaagtctcacttacggaagaacccgcccacatactccagctccacatccatggcggctgtcatcggcaaccccaagctaccatcggccgtgatggacaggtggctgtgggggcccatgccatcggccgaggaagaggcctacatggtgtccgagctgctgggctgccagcccctagtgggcagtgtggccaccaaggagagggtcatgagtgccctgacccaggctgaatgcgtccactttgccacccacatctcctggaagctgtcggccttggtcctcacgcccagcatggacggcaaccctgccagcagcaagagctccttcggccacccctacacgatccctgagtccttgcgggtgcaggacgatgccagtgatggggagagcatctcggactgcccgcccctgcaggagctgctgcttactgccgccgacgtcctggacctgcagctgcctgtgaagctggtggtgcttggctcctcccaggagtccaacagcaaagtcacagccgacggggtcatcgcgctgacaagggccttcctggctgccggcgctcagtgtgtcctcgtgtctctgtggcctgtgccagtggctgcttctaagatgttcatccatgccttctactcatccctgctgaacggcctgaaagccagcgccgccctgggggaggccatgaaggtggtgcagagcagcaaggccttctcgcacccctccaactgggcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccgggctgttaaaaatatggttggaatgctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgttgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagcaaaaaaaaaaaa

SEQ ID NO: 415298 - DNA, 2033 bp, Homo sapiens
ggtatatcaggagctgagtgacttgccaggggagtgcagagctcatgggcacctggctgctgtctacatggcccttgggaaatacacaatggcattcaagtgttatgaagagcaactggatctagggcaaaagctgaaggatccgagtctggaagcccaggtctatggcaacatgggcatcacaaagatgaacatgaatgtgatggaagaagccattggctactttgagcagcaattggccatgctgcagcagctaagtggaaatgagtctgtgctcgacaggggccgggcctatggcaacctgggggattgctacgaagccctgggtgactatgaggaagctatcaaatactatgaacaatatttatctgtcgcgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacagggatgcaaccaggtttgcggaggcctgggattgggcctggacacatgttcttgctctgccaacttctcagccagtgaaggcaggtgacacttacctccaccaggtgatgcaggctgtggtgataaactagagtgtgaagagctcagagtgcagcctctggccttgccactcacaagctgtaggacactagggaggcagtttcacctctgtcagcctcagtctcgtcatctgtgaaatggggatggcttcttaccctgcagggttcctgtaatgtgggaataaaggagccaatgtataaataaaaa

SEQ ID NO: 415299 - DNA, 455 bp, Homo sapiens
cagggctgagttgagtgggaagggagccaagggcaggggatgtaggagctggcagcctggttgtaaggaggccaaaacttcaagctagttcacccttagttccttcttcccagccaccttcacaggtgtccctcatggcttttggtttcatgtagggatgcaaccaggtttgcggaggcctgggattgggcctggacacatgttcttgctctgccaacttctcagccagtgaaggcaggtgacacttacctccaccaggtgatgcaggctgtggtgataaactagagtgtgaagagctcagagtgcagcctctggccttgccactcacaagctgtaggacactagggaggcagtttcacctctgtcagcctcagtctcgtcatctgtgaaatggggatggcttcttaccctgcagggttcctgtaatgtgggaataaaggagccaatgtataaat

SEQ ID NO: 415300 - DNA, 856 bp, Homo sapiens
acagtagtaaatgtttattatctcatattgttactgtgagtcaggaatctagaagtggcttagctgggtggctttggctgagtctgtcataaggttgtaatcacgatgcaaggcaaggatgtggtcatctgaaggttttaactggagatagaggatccatttccaaaatggcttagtcatgtgcctgtttgttgaccgaaggccccagttccttgtcatgaggacttctccatagtgtcttcacggtgtccttccaaagctaatgattcaggagaggacatagtagaaaccacaatgtctctcagcttcaaaagtcacacattgtcatttctacagtatccaaagtgtttacagaggatacctgtgctttctatgggaggggaataaacaagggcatgaatatgagcaggcaagagtaattgggggccaccttagagcctgacagccacatacacacattcagaattaccctgcaaacagttgaaaatatggaactccagactgtagcagacaagtcagagctaggaaactttggaagtactacagttgattactaaagccagtggtatgactaataagaataaatatagattccaggcacagctgcattaaaagaaaaaagaatatagaaagatttttcttgccctttgtatacctgcacatgtcttctgcaaggattgagacaaaattccattgcttgacgatacatgtcagtttttgaacatctttcagggaacttccaaatcaagtctttgtcatatggcttaataattctgtttgaaatgtactctagagatttgatgattgcaagagttaatctgcttcacttgagaatgcggcccaggtagttgactcc

SEQ ID NO: 415301 - DNA, 7038 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415302 - DNA, 7126 bp, Homo sapiens
accggcgaggtggggcgagcggccgacggcgggtgcacgcgtcggtacacgtctgggcggcgacctggtcgcaagccatggtcccacgcggggtcccagggccgccgcgggacttggccgaggtctcccgacttgtgctgtgagatacgttaacgctttctcgacaccaggggtctggacttagtgaccatggacgcttccccctcacctttctctctccccaagaaacttaatgaattatctgcccgtcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415303 - DNA, 7072 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggtgttgttacagatcttataacagtcggtttaaagcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415304 - DNA, 6868 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415305 - DNA, 6783 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatgggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415306 - DNA, 5732 bp, Homo sapiens
gagtttaacgataagcttgattggggatgggggatgcaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415307 - DNA, 7210 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaaaat

SEQ ID NO: 415308 - DNA, 7541 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaaaaaaaaaaaaaaaaaaaaaaaaaaaaaaaaaaaaaaagggggggggggtaaaaaatttccccgggggggcccaatttgtccccgtttttttgtgtacaagggggcctcctaataagggggatcgttattattaaagccataaggcagtaggaggcacgtcgtgttttaacagcgtctcgggagaatgtgggaaaaagtggttaagattggggaattattgtggctgcagagagagaaacgcttaatttgtgtggggggggggtggagaaattaagtggtggaacacaaagtgttaccagttacggaagaatttttataaggggctcgtaggagggggcaacgattaataataatttcttcaaaggcgtattattacatgggtggttttaaaccaaagacggtcgtgaaaattagtgtattggcagcgtctgagaagaagttttggggtaggaccgcgggggaagtaagtaaaattgtcgtgcatacttttttttacgaggagg

SEQ ID NO: 415309 - DNA, 5674 bp, Homo sapiens
  misc_feature (97)..(98): n is a, c, g, or t
  misc_feature (258)..(258): n is a, c, g, or t
aggctttccctcgaaggagggcacaaaagaaagacccaagggtcctgactaagggtatttccagccaaatagtccctttggcatccgcttttaaaanncgcccgggcttctaaaaaaacttccaggaatattcttttccaccatgcagccaactctggcatctttcccaacattccccccttctgttacagtggagatgattctggaaaggaaaacccccttttttttcccaataagagaaagcccttgggaattgtntctccagttggaaggtcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415310 - DNA, 3582 bp, Homo sapiens
  misc_feature (91)..(91): n is a, c, g, or t
ttttgtccgaaaatatctcgtgggacaagaagagaaactgcatgacaatatgctaaacatgtaagcactgctgactgatggcacggagacnctgaaaagaacagagagccaggcgtggtggctcatgcctgtaatcccagcactgtggggaggtggaagcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415311 - DNA, 7071 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttctgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagttttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaaaat

SEQ ID NO: 415312 - DNA, 1011 bp, Homo sapiens
ttagaggaccccctgatatttctgggtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaa

SEQ ID NO: 415313 - DNA, 2379 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctttctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttga

SEQ ID NO: 415314 - DNA, 1426 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtgattcttttaagttggatttgaaatgacttttaatgaagttgtatattttctaggaacttaccaagatgaagaatgttatcatatttgaagaatttaccataaagcattatgcatatcagctgtagaagtgtagtgatttgtatgatatatagcttccttgttatttacaaattattctctctggtcctatttttaattccagtaatcagtatgtgttctgcatcatttatgtttgcttttggcacaaataactataggctaactacattaaataaccttagatttgcctttccagttgttatataaaatgtataagctgctctgtctttactgataaacttatcaattatgtgttgaacagacctgtcttatctttgggccttcaatgcctttgacagtactcaacaaataatatgcagtcatactatacattcactattcatctttggaaaaccttttgtcattaatgggttttgaagattacgatagaggggtatgcat

SEQ ID NO: 415315 - DNA, 619 bp, Homo sapiens
cccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgatgcggccacgccccctttccctcccccacctcccagccgcgcactcaacgcac

SEQ ID NO: 415316 - DNA, 809 bp, Homo sapiens
ttacagaggatacctgtgctttctatgggaggggaataaacaagggcatgaatatgagcaggcaagagtaattgggggccaccttagagcctgacagccacatacacacattcagaattaccctgcaaacagttgaaaatatggaactccagactgtagcagacaagtcagagctaggaaactttggaagtactacagttgattactaaagccagtggtatgactaataagaataaatatagattccaggcacagctgcattaaaagaaaaaagaatatagaaagatttttcttgccctttgtatacctgcacatgtcttctgcaaggattgagacaaaattccattgcttgacgatacatgtcagtttttgaacatctttcagggaacttccaaatcaagtctttgtcatatggcttaataattctgtttgaaatgtactctagagatttgatgattgcaagagttaatctgcttcacttgagaatgcggcccaggtagttgactccctctgatgttttcacagcccttctgttacagtggatgatctgaagaaccttttcatagaagctggatgttcagtgaaggcttttaaattctttcagtaagtctttgctttcaagaaatacattaaaattatttaatatggtatgcaaattttaaaggtagttcagtgaagtcttctggtggaggaaggagtttggaagcaaaattcattctaaatactttctgtatttcttataccattttcaggaaagatcgcaaaatggcgctcattcaattgggatctgtggaagaagcaattcaggc

SEQ ID NO: 415317 - DNA, 2223 bp, Homo sapiens
gagtgctgtggcgcgatctcggcttactgcaacctcccactccctggtttcactgtattctcctgcctcagcctctgagtagctgggattgcaggcgtgagccactgcgcccggcctatactgtatatatttttaaagactgttctaatagatataaaaactgtaaaaaataagtatttttatatagctctcatggattttattaaacagaattggctcaaaaatactatgttacagactgttgggtacccttgcctaacgtgaactggcagtgttaccttgcttttgcagtaatagtctacagattgcaggtctcatcaattccatccaaagtttaaaagcatttaaaattaccaaatctttaaaatcactttggtggtgattccaaattggtaccaagcaaactttctggatgcccaacatgattttcagtaaccaccctttagagtatttgtttactaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggtttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctcttcaaattcattaacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggctttttaattga

SEQ ID NO: 415318 - DNA, 2312 bp, Homo sapiens
gagtgctgtggcgcgatctcggcttactgcaacctcccactccctggtttcactgtattctcctgcctcagcctctgagtagctgggattgcaggcgtgagccactgcgcccggcctatactgtatatatttttaaagactgttctaatagatataaaaactgtaaaaaataagtatttttatatagctctcatggattttattaaacagaattggctcaaaaatactatgttacagactgttgggtacccttgcctaacgtgaactggcagtgttaccttgcttttgcagtaatagtctacagattgcaggtctcatcaattccatccaaagtttaaaagcatttaaaattaccaaatctttaaaatcactttggtggtgattccaaattggtaccaagcaaactttctggatgcccaacatgattttcagtaaccaccctttagagtatttgtttactaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggtttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctcttcaaattcattaacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggctttttaattgataaacttctcttgtcattttttggtatccagctattacctatttaatagatttattgaaatagattattttcataaagaactctataca

SEQ ID NO: 415319 - DNA, 2148 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggagacagggtcttgctctgttgcccaggctggaatgcggtggcacaatcatggctcactgcagcctcaaccttccagggcttaagtgatcctctcacctcatcctcctgagtagctggactataggcgtgcaccaccaacacccagagatgcaccaagacgctaccaaatgcaaattaataagaccaatcctggctgggtgcaatggctcactcctgtaatctcagcactttgggaggccgaggcaggtggatcacagaagctcgggagtttgagaccaccctgaccaacatgaagaaaccccgtctctactaaaaatacaaaattagccgggcatggtggtgcatgcctgtaatcccagatactcaggaggctgaggcaggagaatcgcttgaacctgggaggtgaagtttgcggtgagccgagatcgcgccattgcactccagcctggtcaacaagagtgaaactctgtctcaaaaaaataagaataagacacaatccttgccctcaagattcatacagtctgaaggtaaagaggggacataaatgaaagaagtaattacaaaacagtgtgattggttctgaaaaggcagtgagtaaacagtcctgttgcataaataacaggacaggctagtgttgctgtaaccatgccacaatcttagtggctgaaaacaacaaaggtttacttttcacccctgctgcaagtccattgagggttggctgggggctctgctctggctcatttcttgtcctccctctgagacctaagctgtgggagcagctacccctttgcttgttgtcatggcagaaggaaggaaagttctggaagactcacgctggccattaaatgctctcttttggaaggttcctaactatccacatggctccaattaaccataggggcaggaagtaccatcctctcatggcctccaaatgatgagagctagaagtacttcacaaacattgttagtggcctgatagagtcttagaagccttcacaaagcagacgatctttgagctgtgtctggaagtaagactgtgtctttcaggctgacaagagggggaaagccgagggagaaagtgtttatctgcaccactcagggctcattcgcttgagtcttacacggcttttgtggtcggagatgttcttgcagattgaaatgaaaactgcttcataagcacaaataatgttttcaatgatgtcagctgttcttcatgctttgggggtgattgagagaggcaagtaggtttgaacgagaagctaggggtgcagatatgcaggaaaatatatcagagaaatataaacataagcgttaagggcatctgtttagactgtttctcaagtttcttagtcctggaacagccaattccatggagcatgccaccaggagttgcaacttatagcctaggtggctcttgggaggtgaacgtctttgtggctatgtgagcagcatggaattgtctacgccttttgattggaatgcactcccccttggtgaaagggaatctatgtcttttttctacatgcagttatataacacttagaatcaccattctttcccataaggcttgtacataagccctaccttttgtccctaaggaaggagttggtgaaagtcggcctgtgagtaacattggaattaggcagtagaatttgaagaaatggtagcaacagacagccctctgctcccttaagtctttctttgcctgattattgaatttgtagtagatcaagggggatgccatgcagagaaagaccatcaatcctgggttttaggttcagggtcagttaccagcctcaggatcccggtcagttccgtgctctgtaaaaccgatacctgctttacctaccttccaaggttattttgaaaaggaagtaagattatgcatgtaataaatatcttatgaaagtaccttgaagcgttcaattatttcacaaatgcatggtggtggtgttattagtatttattaaactgatattgtgaaaaattgt

SEQ ID NO: 415320 - DNA, 1783 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaggctgaggcaggagaatcgcttgaacctgggaggtgaagtttgcggtgagccgagatcgcgccattgcactccagcctggtcaacaagagtgaaactctgtctcaaaaaaataagaataagacacaatccttgccctcaagattcatacagtctgaaggtaaagaggggacataaatgaaagaagtaattacaaaacagtgtgattggttctgaaaaggcagtgagtaaacagtcctgttgcataaataacaggacaggctagtgttgctgtaaccatgccacaatcttagtggctgaaaacaacaaaggtttacttttcacccctgctgcaagtccattgagggttggctgggggctctgctctggctcatttcttgtcctccctctgagacctaagctgtgggagcagctacccctttgcttgttgtcatggcagaaggaaggaaagttctggaagactcacgctggccattaaatgctctcttttggaaggttcctaactatccacatggctccaattaaccataggggcaggaagtaccatcctctcatggcctccaaatgatgagagctagaagtacttcacaaacattgttagtggcctgatagagtcttagaagccttcacaaagcagacgatctttgagctgtgtctggaagtaagactgtgtctttcaggctgacaagagggggaaagccgagggagaaagtgtttatctgcaccactcagggctcattcgcttgagtcttacacggcttttgtggtcggagatgttcttgcagattgaaatgaaaactgcttcataagcacaaataatgttttcaatgatgtcagctgttcttcatgctttgggggtgattgagagaggcaagtaggtttgaacgagaagctaggggtgcagatatgcaggaaaatatatcagagaaatataaacataagcgttaagggcatctgtttagactgtttctcaagtttcttagtcctggaacagccaattccatggagcatgccaccaggagttgcaacttatagcctaggtggctcttgggaggtgaacgtctttgtggctatgtgagcagcatggaattgtctacgccttttgattggaatgcactcccccttggtgaaagggaatctatgtcttttttctacatgcagttatataacacttagaatcaccattctttcccataaggcttgtacataagccctaccttttgtccctaaggaaggagttggtgaaagtcggcctgtgagtaacattggaattaggcagtagaatttgaagaaatggtagcaacagacagccctctgctcccttaagtctttctttgcctgattattgaatttgtagtagatcaagggggatgccatgcagagaaagaccatcaatcctgggttttaggttcagggtcagttaccagcctcaggatcccggtcagttccgtgctctgtaaaaccgatacctgctttacctaccttccaaggttattttgaaaaggaagtaagattatgcatgtaataaatatcttatgaaagtaccttgaagcgttcaattatttcacaaatgcatggtggtggtgttattagtatttattaaactgatattgtgaaaaattgt

SEQ ID NO: 415321 - DNA, 1128 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggagaggccatctgcaactcttgaaggccagagttgtatggccctggattctgctccatggacagtaggaaactctgagaggtgttgaggcagctggcagcagtgatgtagccgggatgatacagcaaaaatgccacttcatggagtgagcaagggaaccaggaaaggatgctgaggctttgagatgcttaaatgatgtgcccagggtctagaaggacctgtgtcattggatcaggacctacgttgataatccaggatgatctcttcatctcaaaattgacagggtcttgctctgttgcccaggctggaatgcggtggcacaatcatggctcactgcagcctcaaccttccagggcttaagtgatcctctcacctcatcctcctgagtagctggactataggcgtgcaccaccaacacccagagatgcaccaagacgctaccaaatgcaaattaataagaccaatcctggctgggtgcaatggctcactcctgtaatctcagcactttgggaggccgaggcaggtggatcacagaagctcgggagtttgagaccaccctgaccaacatgaagaaaccccgtctctactaaaaatacaaaattagccgggcatggtggtgcatgcctgtaatcccagatactcaggaggctgaggcaggagaatcgctggaccgggggggcgacactacgggggagcccgaaatacgcccatgggccacacctgggtcgccaagggaagacgtgtggttgtgaacagagaataaagagaaaagtgggcgccgggaaaaaactggggcaaggggggggatagatgaatataacaagcggaggggtgtgtagaggggagagaggcgggcataaataaagaagaaggtgtgggttgcacatgtgttgtagtatgaatactagccagctgatgttagtagttgtgtagtgtgtagagccaaccaggtgaaaaaagaattgtgaagtgg

SEQ ID NO: 415322 - DNA, 454 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggagtaaaggaccccggagggagacgcggggctgagcggtgagcggtgtatcgggcgccccttccccgggcggctgcccctgccctgagcatggagcacgcggctcatcgctgctgccaactagaagggcaaatgcctgctgttccgacgcctccttgaccaactccgaaggatcgtccctggtcccacctaggacacccgggttgggaggctggggttggtaaggaaagatctcagagggagagaaaagggctttcctagaggcccgggtattttggctaggaacttaaatgctaaaa

SEQ ID NO: 415323 - DNA, 806 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggagggcatcaatttgctggttggacagtggctgcttttgaagtttctttgtccaaatgcctggaaaacaaaaaacaacaaaaacgaaacaaacaaacaaaaaaacaacatgcaactgctagtgaagaaagtaaagaggaaatctaggggccagggaagtgaccattcttagccaggaagtaaacttttcatggtgaagcatgatatgcaggagttggatttgggggtttctgaaaatctcagagtaaaaccctcttttgagaggtgaaactcagttttgggacatgaaagggctactgtatctggaaagaaattaagttatattacttctcagtactaggaatccaaaccagaccaacgagggttactcaatattcattctctaaagctcacgtattattggaagtctttgagagatctttttttaaagtcactgttaccattatcaacaacatcaatcttcatccctcataaagccctgtggaataaacaaagtatagatgccatctgatccctgccttttaaaagctcacaacccaataaagggactatatcctgtcacatatataatcttcaaatgcataaatgccagttgaatactgctgcagatcatgagttctgcaggagttcagactagattaggttcagaag

SEQ ID NO: 415324 - DNA, 2950 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccgccctgttccctccccctgttcccccccaaggtagacctgggccagaatggtgaggagaaatcaccacccaatgcgagccaccctcctaaattcaaggtcaagagctcgcctctgattgagaagcttcaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggatgacactcctgtccaggacactaaaatgtgaagaacagctcattgtgccccagtgatgaagttgctggacacatctctttgcaggtagcagcaacagttgtagcagcagcagacgaagccattgcagaggcagaatatgctgagtgtctggagtcagcctgaagacacagggtggattatttcctggcctccacaccaaacgttcccttgcagatggagactgaatctgagggcagcagacttttatcagcttgagtttatgtcatttgatggacttggttcaacaacaagaacttacttaaaacaatgtactgtggtgatgagtcccaggggcactggtcagcctgtggagccctggatgctatccacacccacctatccctgcagctaatttagctgatctctaatttaactgagctctaatttagctgatcagattttgcttgggtaaagttcctttttaatgttctaaagtgtttacggttctcaaatatcagttaaaaactaattttaggtggccataaacataaaatagaaaccctgtaagttacagaagaccctaaattgtatcaaaaccctagagacaacttttcaatttgatccaaatttgaactggccaaccagtctttaaaacactggactagaagagataatgattgaaacatttaaaaaaaaaaagtgctccattcgcaggagcttttcctgtcctgtggttttccagttggtgaccaccatgggaggtcgctggctcggctcactcccttctcccacccttgagaatgtggagaactcccatggagaggcagaatggcaggaggtttcatgtcccgcgttgcatctcctcctgaaagaaaagcagtgatacctgaataatgctggctctccgattgatcctgtgaggatgaatttgcatttccagaatccttgagcatggattagatgtttcctgggaggtgccttgagtaccattatgtgcaagctacataattaaaacatttttcttagtttccctgggaagcttttcttgactcacagcccaggttcttctgcccaacacaaaaggagtgagttggggtctttagtctcttcttattgggtagctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaa

SEQ ID NO: 415325 - DNA, 3091 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccgccctgttccctccccctgttcccccccaaggtagacctgggccagaatggtgaggagaaatcaccacccaatgcgagccaccctcctaaattcaaggtcaagagctcgcctctgattgagaagcttcaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggatgacactcctgtccaggacactaaaatgtgaagaacagctcattgtgccccagtgatgaagttgctggacacatctctttgcaggtagcagcaacagttgtagcagcagcagacgaagccattgcagaggcagaatatgctgagtgtctggagtcagcctgaagacacagggtggattatttcctggcctccacaccaaacgttcccttgcagatggagactgaatctgagggcagcagacttttatcagcttgagtttatgtcatttgatggacttggttcaacaacaagaacttacttaaaacaatgtactgtggtgatgagtcccaggggcactggtcagcctgtggagccctggatgctatccacacccacctatccctgcagctaatttagctgatctctaatttaactgagctctaatttagctgatcagattttgcttgggtaaagttcctttttaatgttctaaagtgtttacggttctcaaatatcagttaaaaactaattttaggtggccataaacataaaatagaaaccctgtaagttacagaagaccctaaattgtatcaaaaccctagagacaacttttcaatttgatccaaatttgaactggccaaccagtctttaaaacactggactagaagagataatgattgaaacatttaaaaaaaaaaagtgctccattcgcaggagcttttcctgtcctgtggttttccagttggtgaccaccatgggaggtcgctggctcggctcactcccttctcccacccttgagaatgtggagaactcccatggagaggcagaatggcaggaggtttcatgtcccgcgttgcatctcctcctgaaagaaaagcagtgatacctgaataatgctggctctccgattgatcctgtgaggatgaatttgcatttccagaatccttgagcatggattagatgtttcctgggaggtgccttgagtaccattatgtgcaagctacataattaaaacatttttcttagtttccctgggaagcttttcttgactcacagcccaggttcttctgcccaacacaaaaggagtgagttggggtctttagtctcttcttattgggtagctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaaaaaaaaaaaaaaaaaaaactcaagggggggccgggtccccatttccccttatgggggggttacaaattaccggccgcgttttaaaccccggaatggaaaaacccggggccccacttaaaagttgtggaaaaaccctttttc

SEQ ID NO: 415326 - DNA, 1622 bp, Homo sapiens
cctcaccattttcctaattaattctttcctcccctgttcacaggatgacactcctgtccaggacactaaaatgtgaagaacagctcattgtgccccagtgatgaagttgctggacacatctctttgcaggtagcagcaacagttgtagcagcagcagacgaagccattgcagaggcagaatatgctgagtgtctggagtcagcctgaagacacagggtggattatttcctggcctccacaccaaacgttcccttgcagatggagactgaatctgagggcagcagacttttatcagcttgagtttatgtcatttgatggacttggttcaacaacaagaacttacttaaaacaatgtactgtggtgatgagtcccaggggcactggtcagcctgtggagccctggatgctatccacacccacctatccctgcagctaatttagctgatctctaatttaactgagctctaatttagctgatcagattttgcttgggtaaagttcctttttaatgttctaaagtgtttacggttctcaaatatcagttaaaaactaattttaggtggccataaacataaaatagaaaccctgtaagttacagaagaccctaaattgtatcaaaaccctagagacaacttttcaatttgatccaaatttgaactggccaaccagtctttaaaacactggactagaagagataatgattgaaacatttaaaaaaaaaaagtgctccattcgcaggagcttttcctgtcctgtggttttccagttggtgaccaccatgggaggtcgctggctcggctcactcccttctcccacccttgagaatgtggagaactcccatggagaggcagaatggcaggaggtttcatgtcccgcgttgcatctcctcctgaaagaaaagcagtgatacctgaataatgctggctctccgattgatcctgtgaggatgaatttgcatttccagaatccttgagcatggattagatgtttcctgggaggtgccttgagtaccattatgtgcaagctacataattaaaacatttttcttagtttccctgggaagcttttcttgactcacagcccaggttcttctgcccaacacaaaaggagtgagttggggtctttagtctcttcttattgggtagctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaa

SEQ ID NO: 415327 - DNA, 1302 bp, Homo sapiens
tccccgtacgcccaatcccctgtacgcccaaatgtactgtggtgatgagtcccaggggcactggtcagcctgtggagccctggatgctatccacacccacctatccctgcagctaatttagctgatctctaatttaactgagctctaatttagctgatcagattttgcttgggtaaagttcctttttaatgttctaaagtgtttacggttctcaaatatcagttaaaaactaattttaggtggccataaacataaaatagaaaccctgtaagttacagaagaccctaaattgtatcaaaaccctagagacaacttttcaatttgatccaaatttgaactggccaaccagtctttaaaacactggactagaagagataatgattgaaacatttaaaaaaaaaaagtgctccattcgcaggagcttttcctgtcctgtggttttccagttggtgaccaccatgggaggtcgctggctcggctcactcccttctcccacccttgagaatgtggagaactcccatggagaggcagaatggcaggaggtttcatgtcccgcgttgcatctcctcctgaaagaaaagcagtgatacctgaataatgctggctctccgattgatcctgtgaggatgaatttgcatttccagaatccttgagcatggattagatgtttcctgggaggtgccttgagtaccattatgtgcaagctacataattaaaacatttttcttagtttccctgggaagcttttcttgactcacagcccaggttcttctgcccaacacaaaaggagtgagttggggtctttagtctcttcttattgggtagctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaa

SEQ ID NO: 415328 - DNA, 1740 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccgccctgttccctccccctgttcccccccaaggtagacctgggccagaatggtgaggagaaatcaccacccaatgcgagccaccctcctaaattcaaggtcaagagctcgcctctgattgagaagcttcaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggatgacactcctgtccaggacactaaaatgtgaagaacagctcattgtgccccagtgatgaagttgctggacacatctctttgcaggtagcagcaacagttgtagcagcagcagacgaagccattgcagaggcagaatatgctgagtgtctggagtcagcctgaagacacagggtggattatttcctggcctccacaccaaacgttcccttgcagatggagactgaatcgcattgaggcagccagcgcaggggctctggctgagggggcaggcggacgtttgaggaaaccgcaagataggttttttctctttgaacagatagagattataacaactacttaaaaaatatagtcataggttactacgatt

SEQ ID NO: 415329 - DNA, 2423 bp, Homo sapiens
ccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggagaggccatctgcaactcttgaaggccagagttgtatggccctggattctgctccatggacagtaggaaactctgagaggtgttgaggcagctggcagcagtgatgtagccgggatgatacagcaaaaatgccacttcatggagtgagcaagggaaccaggaaaggatgctgaggctttgagatgcttaaatgatgtgcccagggtctagaaggacctgtgtcattggatcaggacctacgttgataatccaggatgatctcttcatctcaaaattgacagggtcttgctctgttgcccaggctggaatgcggtggcacaatcatggctcactgcagcctcaaccttccagggcttaagtgatcctctcacctcatcctcctgagtagctggactataggcgtgcaccaccaacacccagagatgcaccaagacgctaccaaatgcaaattaataagaccaatcctggctgggtgcaatggctcactcctgtaatctcagcactttgggaggccgaggcaggtggatcacagaagctcgggagtttgagaccaccctgaccaacatgaagaaaccccgtctctactaaaaatacaaaattagccgggcatggtggtgcatgcctgtaatcccagatactcaggaggctgaggcaggagaatcgcttgaacctgggaggtgaagtttgcggtgagccgagatcgcgccattgcactccagcctggtcaacaagagtgaaactctgtctcaaaaaaataagaataagacacaatccttgccctcaagattcatacagtctgaaggtaaagaggggacataaatgaaagaagtaattacaaaacagtgtgattggttctgaaaaggcagtgagtaaacagtcctgttgcataaataacaggacaggctagtgttgctgtaaccatgccacaatcttagtggctgaaaacaacaaaggtttacttttcacccctgctgcaagtccattgagggttggctgggggctctgctctggctcatttcttgtcctccctctgagacctaagctgtgggagcagctacccctttgcttgttgtcatggcagaaggaaggaaagttctggaagactcacgctggccattaaatgctctcttttggaaggttcctaactatccacatggctccaattaaccataggggcaggaagtaccatcctctcatggcctccaaatgatgagagctagaagtacttcacaaacattgttagtggcctgatagagtcttagaagccttcacaaagcagacgatctttgagctgtgtctggaagtaagactgtgtctttcaggctgacaagagggggaaagccgagggagaaagtgtttatctgcaccactcagggctcattcgcttgagtcttacacggcttttgtggtcggagatgttcttgcagattgaaatgaaaactgcttcataagcacaaataatgttttcaatgatgtcagctgttcttcatgctttgggggtgattgagagaggcaagtaggtttgaacgagaagctaggggtgcagatatgcaggaaaatatatcagagaaatataaacataagcgttaagggcatctgtttagactgtttctcaagtttcttagtcctggaacagccaattccatggagcatgccaccaggagttgcaacttatagcctaggtggctcttgggaggtgaacgtctttgtggctatgtgagcagcatggaattgtctacgccttttgattggaatgcactcccccttggtgaaagggaatctatgtcttttttctacatgcagttatataacacttagaatcaccattctttcccataaggcttgtacataagccctaccttttgtccctaaggaaggagttggtgaaagtcggcctgtgagtaacattggaattaggcagtagaatttgaagaaatggtagcaacagacagccctctgctcccttaagtctttctttgcctgattattgaatttgtagtagatcaagggggatgccatgcagagaaagaccatcaatcctgggttttaggttcagggtcagttaccagcctcaggatcccggtcagttccgtgctctgtaaaaccgatacctgctttacctaccttccaaggttattttgaaaaggaagtaagattatgcatgtaataaatatcttatgaaagtaccttgaagcgttcaattatttcacaaatgcatggtggtggtgttattagtatttattaaactgatattgtgaaaaattgt

SEQ ID NO: 415330 - DNA, 1704 bp, Homo sapiens
gcatgagccacaccactcctggccctggttgtgttttctaagctagactctgtgcttgccggcaaagcttcatgacttctctaaaggggcaataagtttgtcctttagagaagtcagggagctatattcaggcatccagcccagccagttgtcttcaaggaacagggaatcaccttcaaggagactttatagactgcaagaaccactggagtctaatatggaccctccacagaaacatttgcaaggccaggaagctctggcagattagggctggcggtgaggcacgcacacagcgaagctcagcaggtggtgtgcacacatccacccaaagatcacacaaacacaaaacaacagggttctctctgagctggccactgcttcagggcagaggagggaaatggcccaggcaacacccagcttcttgggttgggtgaagtctccttaagaaattgttttagaagtggcttccctcttctggaagtgtacaaactgccttaggccccaggctgcagattcactatgatgtatggcctgtctaacctcttgaagaaacggattggagataagagaaaagcaactcttagacttcaagcaggttgctgctggagggccaaatgcaagtgtcaactttgttctaggaaaacaaggagggtctccttccacagaggcagtttctcccccctcagatgaggaaggaatagtgtatggcagaggccctgaaactatcagctgagcaacttcctgtgtggcttggggggtggaggggattgcagtaaaagagaaggccctcccttattgagatgtgtagtaacttatgcaggattccaccaagataccaaaatcactcccgtgctagggtttgggagggacgcagggagggaatagctcagccagccagaagcctgacaaatcaccctgcgtctcacatccaggcatcaatttgctggttggacagtggctgcttttgaagtttctttgtccaaatgcctggaaaacaaaaaacaacaaaaacgaaacaaacaaacaaaaaaacaacatgcaactgctagtgaagaaagtaaagaggaaatctaggggccagggaagtgaccattcttagccaggaagtaaacttttcatggtgaagcatgatatgcaggagttggatttgggggtttctgaaaatctcagagtaaaaccctcttttgagaggtgaaactcagttttgggacatgaaagggctactgtatctggaaagaaattaagttatattacttctcagtactaggaatccaaaccagaccaacgagggttactcaatattcattctctaaagctcacgtattattggaagtctttgagagatctttttttaaagtcactgttaccattatcaacaacatcaatcttcatccctcataaagccctgtggaataaacaaagtatagatgccatctgatccctgccttttaaaagctcacaacccaataaagggactatatcctgtcaaaaaaaatagagtactactgctggcgtaactgagactcaatgccatagagtacctgcttgaaaggccactaaagaaaaaacatgtcggccgcttgggcccagtcgactttatattcgacaggcttatgcagcggcccaaattgggctaatttggccaatgcgcctatagggggcgttttcaattaattgcccgcctttacaacgacttgactgtga

SEQ ID NO: 415331 - DNA, 1172 bp, Homo sapiens
cagtaacagaaaaaaatgaaagtaataagataaatccaaggtcactgagtatagtagatgcccagctaagtgggtgagtgggagctgaaatccaagtcacttggaggaaaaggttactttttgttcatacaaaatctccttgcctagttgagcctcaaacgggtggctttttctaattcatgcagaggccatctgcaactcttgaaggccagagttgtatggccctggattctgctccatggacagtaggaaactctgagaggtgttgaggcagctggcagcagtgatgtagccgggatgatacagcaaaaatgccacttcatggagtgagcaagggaaccaggtgagaaagcatcttttcgagtacaggtatattctgacttcaggatacaataagaatggagaagatggaaaagagtaaagaccatgcgctggaagggaagtcagaaatcaccaagctgcccagaagagtgaagttctctatggtgccagggaaaatggcagtaccaacttttacagctccatacaaagccttttgcaggcagattttctcattggtctttgagtctccagaatgagcacggtgcctggcatatagtcatataatttctcaataaaagtttgcttgataaatgattaaagaaaaagaaaaaaacaaaaacaaaaaaaaaaaaaaaaacaaacaaaaaagcacaacaaagcaaaacacaacaacaaaaaaaaaagaacaaaaacgacaaaacaccgcaaggcaacagccgcaacccaagagacaatagacacatagtagataacaataaataccaaccaatagagagaggaggagacgagaatgcacaaccggagcagccaccacaaacacaaacaatgacaactagcgcctgtagacgacgggcgagacgacggagaatggagtaaaagaagacgagccagcaaccgtgagagtgaccgcgagaggacccgaaatgtgctagaagacagagaggacgaggatggctcaagtaaaagaaaaggagtagtagtctccgcagacaagggagagaaagagaagacaaaagcagcgcgacgatacacgagaacgcgacggaagacgacgcgacaacaaagcataagagcaggggaggcagagacacagccaaacacaagcagcaccaggcgcagggcccagcagg

SEQ ID NO: 415332 - DNA, 397 bp, Homo sapiens
ctcaagctctgatccctgggttaaaatcctgacttcaccacttactagctgtgtgacctaggggaaataacctctctgtgccttcattgcctcacctatgatagagttaataaaagtaactacctcatattgcttttgtgaggattaaataagtcaatgcataaaaaaaactaagttgggcacatagcattcttatgactatcattcttactattactcctactgttactattattgccagatccatcatccccaaggagggatgctgagtgtcaggatttcctcaccattttcctaattaattctttcctcccctgttcacaggatgacactcctgtccaggacactaaaatgtgaagaacagctcattgtgccccagtgatgaagttgctggaca

SEQ ID NO: 415333 - DNA, 603 bp, Homo sapiens
cagtgcggaagtgctgcccaggtggagaatctgatgccagtggagttggcaggtgtatgagtttgcgagggctgctgccgtaacagattaccacaaactgggtggctcaaaacaacagaaacgtctcctttcatggttctggaggccggatgtctaaaagcagagtgtcagcaggacctcattccccactaaggctcgaggggcggctccattccatgtttcttttggctcctggtggttgccagcttccttgacttgtggccacatcactccagtctgcctcatctttgccacaccttctcctctgtgtgtctcttataaggacctgtgtcattggatcaggacctacgttgataatccaggatgatctcttcatctcaaaattggtaactacctctgctaagactgtttttgcacataaggtaacattcacaggttccagggattaggaagtgagcatatctttttttttcctcctcaagacagggtcttgctctgttgcccaggctggaatgcggtggcacaatcatggctcactgcagcctcaaccttccagggcttaagtgatcctctcacctcatcctcctgagtagctggactata

SEQ ID NO: 415334 - DNA, 505 bp, Homo sapiens
ctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaatttgggagatgtgtgtgtcaattatttt

SEQ ID NO: 415335 - DNA, 235 bp, Homo sapiens
aaagatttattagttcctaattatatatagaaaaagactttgaaaattacttaagccatgattctaccaagatgtaaccacttttattttcttttttccttcccaatgttgactggttatatgcatattaatggagctataataataattgtatactttttatcttactttctaaaccacattattattccttaaatattgctctttcttctgacacagtcttctcatgtatcat

SEQ ID NO: 415336 - DNA, 1572 bp, Homo sapiens
ggcggctttcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgaggtcagtcatcgttacccgcagcggcgccattttgcccaaaccggtgaaaatgtccttcggccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattcttgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgttttaggcttttgttataatgttgggcacttcgggcctcagaaaacagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacgga

SEQ ID NO: 415337 - DNA, 1039 bp, Homo sapiens
  misc_feature (793)..(793): n is a, c, g, or t
  misc_feature (806)..(807): n is a, c, g, or t
ggcggctttcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgaggtcagtcatcgttacccgcagcggcgccattttgcccaaaccggtgaaaatgtccttcggccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaantacatggtttacnntgttccaatatgattccacccatggcacatcccatggcaccgtcaaggctgagaaccgggaagcttgtcatccattggacatcccatcaaccatctttccacgagcgagataccctcaaaatcagtggggcgatgctgcgctgagtacgtcggggagccccctgggtttcacaccatgaaaagcggggccattgcaggggagccacaggtctcaccttgcccttgtgttccc

SEQ ID NO: 415338 - DNA, 1523 bp, Homo sapiens
ggcggctttcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgagatgtccttcggccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattcttgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgttttaggcttttgttataatgttgggcacttcgggcctcagaaaacagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacgga

SEQ ID NO: 415339 - DNA, 1868 bp, Homo sapiens
ctcaaactcccgacctcaggtgatccacccaccttggcctcccaaagtgctgtgattacaggcgtgagccactgcgcccagccaacttcatgtgctctaatatgtgctgcatggcattctgtcaagagatgaggacactcctgttccttagcctggcattcaaggcttgccataatctggtcacacctcttattccagtctcatcttccatatttccagccacacaccgattcccagtattcaccatttcttgagttttcacactcatacccacccccaaacattggctcattgttcctcccacatggaaggctccttcccagagctctgggtcttaattccacccattctacagtgtctttgaagtcttcgttcctcctttcatttgaaagttgacggctccttcctctaagcaaccagtacctctcttcaaatactcggtattatgtggctaaacacacacaaagcaaaattttactagactctgagcttcttgctggcaggggacgttttttatacattgcggcccccagtgcctggcctgtggtgaatgcccagttaacgtgcgcatgaacaaccaaacgtgctcaaagctgcctttctcctgccatgtttgatagaagcactttgtggaattctttcagtctgcggatggaagactacgctgttgcccagttcactgctgctttcctttcttacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattcttgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgttttaggcttttgttataatgttgggcacttcgggcctcagaaaacagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacgga

SEQ ID NO: 415340 - DNA, 1814 bp, Homo sapiens
ctcaaactcccgacctcaggtgatccacccaccttggcctcccaaagtgctgtgattacaggcgtgagccactgcgcccagccaacttcatgtgctctaatatgtgctgcatggcattctgtcaagagatgaggacactcctgttccttagcctggcattcaaggcttgccataatctggtcacacctcttattccagtctcatcttccatatttccagccacacaccgattcccagtattcaccatttcttgagttttcacactcatacccacccccaaacattggctcattgttcctcccacatggaaggctccttcccagagctctgggtcttaattccacccattctacagtgtctttgaagtcttcgttcctcctttcatttgaaagttgacggctccttcctctaagcaaccagtacctctcttcaaatactcggtattatgtggctaaacacacacaaagcgcggcccccagtgcctggcctgtggtgaatgcccagttaacgtgcgcatgaacaaccaaacgtgctcaaagctgcctttctcctgccatgtttgatagaagcactttgtggaattctttcagtctgcggatggaagactacgctgttgcccagttcactgctgctttcctttcttacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattcttgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgttttaggcttttgttataatgttgggcacttcgggcctcagaaaacagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacgga

SEQ ID NO: 415341 - DNA, 1431 bp, Homo sapiens
ggcggctttcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgaggtcagtcatcgttacccgcagcggcgccattttgcccaaaccggtgaaagaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattcttgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgttttaggcttttgttataatgttgggcacttcgggcctcagaaaacagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacgga

SEQ ID NO: 415342 - DNA, 566 bp, Homo sapiens
  misc_feature (426)..(426): n is a, c, g, or t
  misc_feature (471)..(471): n is a, c, g, or t
  misc_feature (513)..(513): n is a, c, g, or t
  misc_feature (540)..(540): n is a, c, g, or t
ggcggctttcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgaggtcagtcatcgttacccgcagcggcgccattttgcccaaaccggtgaaaatgtccttcggccttctccgtgtgttctccattgtgatcccctttctctatgtcgggacactcattagcaagaactttgctgctctacttgaggaacatgacatttttgttccagaggatgatgatgatgatgactaacagaattacagaaaggagaaagcnctaactgaagaaatagtttatgctgtaatagtttatgctgtaatngtttatgctgtaatagtttatgctgtaatagtttatgctgtnatagtttatgctgtaatagttatgctntaatcagtctatgctgtaatagttat

SEQ ID NO: 415343 - DNA, 353 bp, Homo sapiens
ttttctaattacttttcttgccctgaatttttccaaggactttaaaatcaagttgcttatgatgggtctgagggtatgtctgtgagagggccaggtcttctttggtcctgccagagtgggctctggagctcacagctgccactctgaccctctgcagatgtccttcggccttctccgtgtgttctccattgtgatcccctttctctatgtcgggacactcattagcaagaactttgctgctctacttgaggaacatgacatttttgttccagaggatgatgatgatgatgactaacaggtaagacttgctttaccctagatggagcaggaagcagggtggagcatctgtctgt

SEQ ID NO: 415344 - DNA, 2845 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415345 - DNA, 837 bp, Homo sapiens
  misc_feature (711)..(711): n is a, c, g, or t
  misc_feature (729)..(729): n is a, c, g, or t
  misc_feature (734)..(734): n is a, c, g, or t
  misc_feature (755)..(755): n is a, c, g, or t
  misc_feature (774)..(775): n is a, c, g, or t
  misc_feature (799)..(799): n is a, c, g, or t
ggccatcgctagctgggggcggggccggaagctctttccccgcgactgcgccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgggggaggtggtaganaagaaggagagttggggnaaagngtgtttggagaaggaggtttnaagagagagttgttgaatnnaaaagtggaaattgtggttggagngtttttggggggttggatttgagatttaagggtgaggt

SEQ ID NO: 415346 - DNA, 395 bp, Homo sapiens
  misc_feature (4)..(4): n is a, c, g, or t
gggncccccccccccttttgggggttttaaaaaaatttttcccttttcccccaaaaaaacccccaaccccttttttttttggggggaaaaaaaggttccaaaaagggggtgcaggtgatggtcctaccagtgtgtctgttgaggtcacccgtcctaaagtgacctccctgaaagcctgagttgaaatccagactccacttcttgaggcctggccttggactcttgggcagcctctggaaatcctcctcttcaggcccagcggataccccaccttccctgtccatgtcttccttgtactccctgtattacccattgatgtgtaacaggtcaccctaaaacttcacctaaaatagcaatgatttatcatgtctcattgaatttgagacggggcacgc

SEQ ID NO: 415347 - DNA, 574 bp, Homo sapiens
gtgagcacaggattagggctaacgttacaggttaacagcatctcaaagcagaacaatttttctttgtacagatcaagatggagtttcttttgtcttccttttctaggtaggcacagtaacagtctgatctttgccccacactcacccacttcctgctgtgttacccttccctgcccaagttcctgaaacgcagatggggatcctgatagcatcaccacttagggaataagtgagttggccgggcgcggtggctcatgcctgtaatctcaacactttgggaagtcaaggtgcaggtgatggtcctaccagtgtgtctgttgaggtcacccgtcctaaagtgacctccctgaaagcctgagttgaaatccagactccacttcttgaggcctggccttggactcttgggcagcctctggaaatcctcctcttcaggcccagcggataccccaccttccctgtccatgtcttccttgtactccctgtattacccattgatgtgtaacaggtcaccctaaaacttcacctaaaatagcaatgatttatcatgtctcattgaatttgagacggggcacgc

SEQ ID NO: 415348 - DNA, 2815 bp, Homo sapiens
  misc_feature (46)..(46): n is a, c, g, or t
  misc_feature (48)..(48): n is a, c, g, or t
tggctaggtcgaggccggtgctaatcggccgagggcacgctgaggngntgtggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415349 - DNA, 2956 bp, Homo sapiens
  misc_feature (46)..(46): n is a, c, g, or t
  misc_feature (48)..(48): n is a, c, g, or t
tggctaggtcgaggccggtgctaatcggccgagggcacgctgaggngntgtggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggtaagggcccacggtgtgcgtgtatcagtgccctgccctagcactacctgctgcagagcctgcagtgtctccttcagcactggtgcgggtgggtggtcaaatcaccacttctgtgtgatcttgctgggattcctcccttaggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415350 - DNA, 2813 bp, Homo sapiens
ctcggactgatgtggccacgttcatgaggctggctagtgtgcctggcgatcgtgatgtcctgcagctcgatgtgacgcctgggggcagcgtcactgatgtgcgtgactgggtctcggtgctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415351 - DNA, 2909 bp, Homo sapiens
ctctggcccagctggggtgacctcggccgagaggaccctgtcaggggggcggattcggatccttccgggtccgagcagggccgggtttcggccggcactgccgttaggaccgaaggcgcgcgtggcggcccagcagctccagcgaggggtcgcgcagcagcggggtctccccactccccgccgccccctgtgagatcgttctgcatgggttcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415352 - DNA, 3030 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaaaaaagaaaagaaaagagatcttatttagcggcgcagctatcccttagtgaggtattagctgcactgcggcgtttcacgtctgatggcgacttgcgtacgacttactgcttagaatctcttgcagctgtatacgaaggccgatcgtctcaagtcgtgatgatgggccgctttcggatagggggttt

SEQ ID NO: 415353 - DNA, 2749 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415354 - DNA, 4039 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagccagtgggccgcgcgccggccggccccgcgagagaatattataacaacacacctggtggtggggcggcggcgcgccccccgaggagaggtgagagcaggggggaacgagtggggtcccaacagaagaaacaacactggaggaacgatccaacaaaggaggggggaggactctacaccacacaaaaaaaaaaaaaccgcccgccgcgggaagaacacaccacgagagtactgttctgcagcgaacaacaaaccacaagagaaaggagggagtccacgagagaggcaaatacattgtcggggagcaataatctaaaacaagcaacaggcaacgagaccaaacaagaaaaagaagctaccagcaatatataaaaaaaaacgagccaccacgccgcggggggtggggggtgtcttaacaagacacaaacaaagagcaaacacaagcagcagaagaaagaacaaagaacgaaacaaagaagcagcaagaagaacgaaaaaaaagaaagcataggaggaagaggaacgaaacgaaaagaaaagaagaagagggagaagcgagaaacgaaaacaaaaagacagcaaggacatgagaagaatagacgagagggggaggaagaggagagaaaagagggagaggaggccacggagagcgaagaagagaagagagaaggaaggaagagagaggcaaggacagagagagaggaggaggcggaaggagaaaagggagagaaaggagaggagggagagagagaggagggcaagaagggaggggggagaggcgggaggaggaggatgggagggagatgggaggaggggaggcagcacgagagggaggagaggagcaggggaagggaggagagaggaggaagagaggaggaagagaggcgagggaaagaggaacgaaagacaaggggagacgggaggggaggaggagagagggcgaagagagagggaagatgaaagagcagcagaaaaagacagacaacaaagagcagaaaaaaaaaaaacgccgaaagagagaaggagagagacgacgcaagaggaggaagccgaacagacgagcaaaaaggcagagaaatgacaaggacacagggaaa

SEQ ID NO: 415355 - DNA, 2630 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagacagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415356 - DNA, 1236 bp, Homo sapiens
  misc_feature (22)..(23): n is a, c, g, or t
  misc_feature (26)..(26): n is a, c, g, or t
  misc_feature (28)..(28): n is a, c, g, or t
  misc_feature (30)..(30): n is a, c, g, or t
tatagggaatttggccctcgannagnantncttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415357 - DNA, 2267 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagcttgccagacaggcccatttctaggtctgttctcctgaaaatacatctttggtgctgggtagatcctgaatcctgagaatacaagtttctgctcctggatacacagtcacatgactcagaagatcccagcccagtggctagcccaaggctgcagtccactccttcatccacagcccgttctccccaagggtctcacttcatcgaaggcgccgataacacagtagggtggcct

SEQ ID NO: 415358 - DNA, 2152 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415359 - DNA, 1975 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggactcatgctggtggaatgtgctctggggggggtccttttttgccttggggagcattcccgggtggctctgccggtggggtgggggcgacctggg

SEQ ID NO: 415360 - DNA, 2013 bp, Homo sapiens
ggccatcgctagctgggggcggggccggaagctctttccccgcgactgcgccacgtctgaggcggctgtggccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaattataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctgttgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttccagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagactaa

SEQ ID NO: 415361 - DNA, 909 bp, Homo sapiens
gtgagcacaggattagggctaacgttacaggttaacagcatctcaaagcagaacaatttttctttgtacagatcaagatggagtttcttttgtcttccttttctaggtaggcacagtaacagtctgatctttgccccacactcacccacttcctgctgtgttacccttccctgcccaagttcctgaaacgcagatggggatcctgatagcatcaccacttagggaataagtgagttggccgggcgcggtggctcatgcctgtaatctcaacactttgggaagtcaaggtgagtgaatcacaaggtcaggagttcgagaccatcctgaccaacatggtgaaaccccgtctctactaaaaatacaaaaattagctgggtgtggtggcacgtgcctataatcccagctactcaggaggctgaggcagcagaattgcttgaacctggcagacggaggttgcagcgagctgagattgtgccattgcactccagcctgggcgacagagcgagactctgtctcagaaaaaaaaagaaaaaaaagagagtaaacatgaagtgcttcgaatacacagcctggcacgatcacagcgaagtgaaggtcagcagttgtactgtgctttatacaggtgcaggtgatggtcctaccagtgtgtctgttgaggtcacccgtcctaaagtgacctccctgaaagcctgagttgaaatccagactccacttcttgaggcctggccttggactcttgggcagcctctggaaatcctcctcttcaggcccagcggataccccaccttccctgtccatgtcttccttgtactccctgtattacccattgatgtgtaacaggtcaccctaaaacttcacctaaaatagcaatgatttatcatgtctcattgaatttgagacggggcacgc

SEQ ID NO: 415362 - DNA, 557 bp, Homo sapiens
  misc_feature (46)..(46): n is a, c, g, or t
  misc_feature (48)..(48): n is a, c, g, or t
tggctaggtcgaggccggtgctaatcggccgagggcacgctgaggngntgtggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggtgcaggtgatggtcctaccagtgtgtctgttgaggtcacccgtcctaaagtgacctccctgaaagcctgagttgaaatccagactccacttcttgaggcctggccttggactcttgggcagcctctggaaatcctcctcttcaggcccagcggataccccaccttccctgtccatgtcttccttgtactccctgtattacccattgatgtgtaacaggtcaccctaaaacttcacctaaaatagcaatgatttatcatgtctcattgaatttgagacggggcacgc

SEQ ID NO: 415363 - DNA, 1433 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415364 - DNA, 2982 bp, Homo sapiens
  misc_feature (989)..(989): n is a, c, g, or t
  misc_feature (995)..(995): n is a, c, g, or t
  misc_feature (1045)..(1045): n is a, c, g, or t
  misc_feature (1066)..(1066): n is a, c, g, or t
  misc_feature (1072)..(1072): n is a, c, g, or t
  misc_feature (1076)..(1076): n is a, c, g, or t
  misc_feature (1080)..(1080): n is a, c, g, or t
  misc_feature (1088)..(1088): n is a, c, g, or t
  misc_feature (1105)..(1105): n is a, c, g, or t
  misc_feature (1112)..(1112): n is a, c, g, or t
  misc_feature (1149)..(1149): n is a, c, g, or t
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgtaagattattttaaaaatccaacagaccagttatttgtgaaccttaaattgctttttcttgtagggacaaagattatttggtattgtagaggtgacagtcatgatgccgttgtttggagacttttgaaactttgatatgaaagttcataaacactaggccgggtgtggtggctcatgcctgtaatcccggcactttggcaggtggatgcaggtagatcatctgagctcaggaattcaagancagccngggcaacatggcgagaacccatctctaccaaaaatacaaaaaattagccngctgtagtggcccatgcctgnggtccnggcnactngggaggcngaggtgggaggatcacntgagccngggaggcagagattgcagtgagctgagattgcgccantgcactccggcctggctgacagtgagaccctgtctcaaaaaagaaaaaaaagtccataaactctagatgtggatggaaccttaaaggatctctcattctgctttagcagaaaaggccagaacctctttaccagtgctctcctggctcctttgcttctagctcatgagactctgggtttatcatctttaaaatccttatcatataggaggatgatacctcctactgagggtatcttatgagtctcccaacgtctaaagtgacatttattataataccctgttagatgaccactgacttgtatttgaagattacttgtcactgccacataaactgtccagttcattttttagatagaactctgatttaaaaaaaagatttctttatatttgaatgaagttggcttctgtcttaacttcctggcatggtcctatggagaaattaagaacagctcttactggctcttctctaagaggaccttcaagtatactggttttgttgcccagtaaatactttagggtagccatctgagttttcagtccttctttaagtggtatagctcctgggcttttgtcttttctaatttgtctttctaaaaaccattgagattgatagtagctcgggtagaaggccttggagatgccaatgtagtagtgtggtgtggggtctggcatctatttttaataagacttcaggtaactcaggtgcccagagccatttgtgtatgttctatttaataggatgtagtccaaacttcttcatcttaggataaagtctaaatctttgttttttgctattgtactaaactcataaatcctaggttataaagataaagccttaaactttatctcatcatccagcccaatttccagccacaatgaagtacttaaaactctgtgtctttgtacttgctgttctcttggcctccaattccttttcatcttttccattcggtaaagtttgtttatcccacaggccccatcttggaagcctccagcaacttctccagacagaggtgttagcagtgtaggatcagatttctcaaccacgtcactcccatgtctgggtagatatctctgcccaagtgttctcatagcacttgagcagtactctctaagcgcccaggatctaccatgttgcttttttaaaatttgattaatttatttttttatactgctccttgtggagcaggagtgttcccagagtagcccaccatgttatattgaaatggatctgtgtgcataatgcagctgtccatctacatcgtatatttttgtctcctcaagggtagggaccacatgagccttattcttggggctttgatctctacatgatgcagacttacatctattactgtaacccaagtctgcatgagggcagaatccagaaggaaaaggaatcccatggctgtgacttgccctgttatcctaagacagatgtgttctgtagtcctgggctgggagcctctgccttggcctccccagatcaaagtcttctgaccccactggagcttccccacatacatgttcatccttcccctgctcttagaagttggctttgcaaaacaataggttgggtggtgggaagatgtcacaggcatattcactggcctactttacagggcagtatgtaggtgtctgaggaggtatctgtggttgagtaaagctcctaggagttcttttagaaatacaaagaaggcagaaaggctgtcacaaaccttatcaagagtcttactctgatgtcagcttgtatatcactgatgtctggtctgaatttgactataccatgcaaactacttttagttagtaaagttagtttgtttaacaaacaacaggc

SEQ ID NO: 415365 - DNA, 1290 bp, Homo sapiens
  misc_feature (1290)..(1290): n is a, c, g, or t
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcgagacagtctcactctttcgcccagactggaatgcagtggcaccatctcaactcactgcaacctccacctcctggattcaagcaattctcctgcctcagcctcctgagtagctgggattacaggcgcacgcgccaccacatctggctaattttttttctgtatttttagtagagacattgtttcgccatgttggccaagctagtcttgaacccctgacctcaggtgatctgccagcatcggcctcccaaagtgctgggattacaggtgtgagtgccatgcccagctggatgattaagttctttatagcattttactcttgtataaattgctgaagtaaaaaatcttagtatn

SEQ ID NO: 415366 - DNA, 392 bp, Homo sapiens
  misc_feature (16)..(16): n is a, c, g, or t
ctaattctcttttttnccaatgggttttttccccttccattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagtta

SEQ ID NO: 415367 - DNA, 488 bp, Homo sapiens
gtagtgcagacagttgtgggtgggaatcagaagacctagattctatcggctatgccccttactttatttatttatttttgccccttactttaaaaccttgggcaagtcacttaatctcacccaacttctaaaaaaaaaaaaaaaaaaaagaaaaaagaagaagggaataaatatggaataaatttaagatatataatgtggattaacctgggccctactcactgaggagggctaattgttggatttaatttatgtatattatatgaacttttggtttatcatttataaactgttaaccagctattcttcccctttttaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415368 - DNA, 2285 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415369 - DNA, 2230 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagtta

SEQ ID NO: 415370 - DNA, 2447 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaataattgtagttgctctttattttctaattattggagagtgtctcctttgtctattcctgtcccagtgaaagttttacttaggttgttaatgccctgcggaccattatgattccttttacttcttttttgccacgaagctagctagtcaagtcaacaaatagg

SEQ ID NO: 415371 - DNA, 1541 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaaacaacacacacaactaacagcaacacaaaaaaaggggggcgagaacccagagcgcaacagaccccattaaaggcacacaagagataacacaacgggcaaacgagagaa

SEQ ID NO: 415372 - DNA, 2195 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415373 - DNA, 1378 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagtta

SEQ ID NO: 415374 - DNA, 1338 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415375 - DNA, 3077 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacgtaaggcggcgcctccgggcggcgcgggcccggacgggccgctgtccccgccctgcgccgggcgcggggggagggcaccggaggcaggtgccgggcggaggcccggcgcggcgttagtagagacgcgccgggtgccagcccctcgccgcaccttaaattgttgacaaagtgctcccactttgtggctggagccgtacgaccttggcgcgggtccccgagtggcgggctggaaaagctggaggccagagccgttcgcggactcgcccgagcccagccagccagtggggagaggcaggacgcggactccgcgtgctttgattgcgcccggcagtcctcggcgtgggctcccggcctcgcagcggcagctgcagctgcagcggcacgcgagagctgtcaaatgcacgttctcggaccccacccggacccgcggaattcgaatctctgggtgggtccgcgcaactgtggagtggccctccaggtgatggtgtgtattgcttgcaaagtttgagaaccactcagttatggagcactcagaggctgcagccggagtccagccctttgggttaaggttagagggagctagggtttccttttaaaattcatgctgcataaagggtagggtggcctttctccttttccgggtcattttggttaaaaagataaagatgttcgaagtaattactcagagcgcaggggccggggcttggctttactgttgcaggtgataaccttgtcaactgcttattagtgaatgctgaacaaatttcccaaagtttgtatttttaaaaatagaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415376 - DNA, 2225 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacgtaaggcggcgcctccgggcggcgcgggcccggacgggccgctgtccccgccctgcgccgggcgcggggggagggcaccggaggcaggtgccgggcggaggcccggcgcggcgttagtagagacgcgccgggtgccagcccctcgccgcaccttaaattgttgacaaagtgctcccactttgtggctggagccgtacgaccttggcgcgggtccccgagtggcgggctggaaaagctggaggccagagccgttcgcggactcgcccgagcccagccagccagtggggagaggcaggacgcggactccgcgtgctttgattgcgcccggcagtcctcggcgtgggctcccggcctcgcagcggcagctgcagctgcagcggcacgcgagagctgtcaaatgcacgttctcggaccccacccggacccgcggaattcgaatctctgggtgggtccgcgcaactgtggagtggccctccaggtgatggtgtgtattgcttgcaaagtttgagaaccactcagttatggagcactcagaggctgcagccggagtccagccctttgggttaaggttagagggagctagggtttccttttaaaattcatgctgcataaagggtagggtggcctttctccttttccgggtcattttggttaaaaagataaagatgttcgaagtaattactcagagcgcaggggccggggcttggctttactgttgcaggtgataaccttgtcaactgcttattagtgaatgctgaacaaatttcccaaagtttgtatttttaaaaatagaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415377 - DNA, 2769 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacgtaaggcggcgcctccgggcggcgcgggcccggacgggccgctgtccccgccctgcgccgggcgcggggggagggcaccggaggcaggtgccgggcggaggcccggcgcggcgttagtagagacgcgccgggtgccagcccctcgccgcaccttaaattgttgacaaagtgctcccactttgtggctggagccgtacgaccttggcgcgggtccccgagtggcgggctggaaaagctggaggccagagccgttcgcggactcgcccgagcccagccagccagtggggagaggcaggacgcggactccgcgtgctttgattgcgcccggcagtcctcggcgtgggctcccggcctcgcagcggcagctgcagctgcagcggcacgcgagagctgtcaaatgcacgttctcggaccccacccggacccgcggaattcgaatctctgggtgggtccgcgcaactgtggagtggccctccaggtgatgaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415378 - DNA, 2788 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacgtaaggcggcgcctccgggcggcgcgggcccggacgggccgctgtccccgccctgcgccgggcgcggggggagggcaccggaggcaggtgccgggcggaggcccggcgcggcgttagtagagacgcgccgggtgccagcccctcgccgcaccttaaattgttgacaaagtgctcccactttgtggctggagccgtacgaccttggcgcgggtccccgagtggcgggctggaaaagctggaggccagagccgttcgcggactcgcccgagcccagccagccagtggggagaggcaggacgcggactccgcgtgctttgattgcgcccggcagtcctcggcgtgggctcccggcctcgcagcggcagctgcagctgcagcggcacgcgagagctgtcaaatgcacgttctcggaccccacccggacccgcggaattcgaatctctgggtgggtccgcgcaactgtggagtggccctccaggtgatgtttgtatttttaaaaatagaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415379 - DNA, 2597 bp, Homo sapiens
gcgttccgccgggagcaggcgctggcgcagagcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacgtaaggcggcgcctccgggcggcgcgggcccggacgggccgctgtccccgccctgcgccgggcgcggggggagggcaccggaggcaggtgccgggcggaggcccggcgcggcgttagtagagacgcgccgggtgccagcccctcgccgcaccttaaattgttgacaaagtgctcccactttgtggctggagccgtacgaccttggcgcgggtccccgagtggcgggctggaaaagctggaggccagagccgttcgcggaattcgaatctctgggtgggtccgcgcaactgtggagtggccctccaggtgatgaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415380 - DNA, 1943 bp, Homo sapiens
cggccgctgctgtccccagacatagcgccaattcaccgtgcaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415381 - DNA, 1702 bp, Homo sapiens
ggaattgtaacgggaaacaatttcacccgggtccaacttatggcagattacctattttatccgcttcgccataggaatttgggccttgaggagccaaaatttagcccaaggcagtcaattcagcaaagatccccctttaataaaacccatacattcccctttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccagtgcctaaatgttcattattgtctgccaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaa

SEQ ID NO: 415382 - DNA, 650 bp, Homo sapiens
gtagtgcagacagttgtgggtgggaatcagaagacctagattctatcggctatgccccttactttatttatttatttttgccccttactttaaaaccttgggcaagtcacttaatctcacccaacttctaaaaaaaaaaaaaaaaaaaagaaaaaagaagaagggaataaatatggaataaatttaagatatataatgtggattaacctgggccctactcactgaggagggctaattgttggatttaatttatgtatattatatgaacttttggtttatcatttataaactgttaaccagctattcttcccctttttaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaataattgtagttgctctttattttctaattattggagagtgtctcctttgtctattcctgtcccagtgaaagttttacttaggttgttaatgccctgcggaccattatgattccttttacttcttttttgccacgaagctagctagtcaagtcaacaaatagg

SEQ ID NO: 415383 - DNA, 114 bp, Homo sapiens
gaacagctgcattgctggtgggggctgtaccatggaggagagggggagctgtcaatcaaccaccattgcagactctgcagcacccgagtggcgacagagatggtgtggtgagag

SEQ ID NO: 415384 - DNA, 371 bp, Homo sapiens
aaaataattttggtggtaaaagaaatacaaagttaattgtggaaaatattggaagtaataaggacagtgataaaaactcacccgtaattccaagataatgactgttaatattttgctctatttgattttgggcccaccttcttacatgggtatgcaagaatacataccctgttcccaccactccagcctttcatggcaaaactggtctcgtattgtaaaataggtaatatttcctaacctccttttaaaaaatcttattgtgtgactattttcctatcgtgaaatgttttcctaaaatgtgactatcccaatatgtatttaatcattttcttaccattaagacttggcataaaaatctcttcatatctctt

SEQ ID NO: 415385 - DNA, 2167 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 415386 - DNA, 612 bp, Homo sapiens
gctttcctggtttcattgtgctggctttggcctggcttagccactcatgtcactcacctctgccttcgagttggctgggtaggtgcagacaagtgtgaatggctatttttttcttttacttctccctttcccccaggccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 415387 - DNA, 941 bp, Homo sapiens
gctttcctggtttcattgtgctggctttggcctggcttagccactcatgtcactcacctctgccttcgagttggctgggtaggtgcagacaagtgtgaatggctatttttttcttttacttctccctttcccccaggccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatgctagctggctgtctttgttcttggagaggtggagtgactgttcacggagaatgcacggcatggggatgaaccctttccctctgcttttgagccctgttctgggctccaaggtgctgtatgatctaggccgtgctggccaggagacaatcctatggggatggcagtggtgtcttgtgctctgtcccctagagcagtcactggccacaggtagccacctgcctttctcccggcttccctagcagagtttgctcaggcacaaatgtgcacctggagcatttgaaatgtgctagtgaggctgaggaagagaattttaaatttcattgaattgt

SEQ ID NO: 415388 - DNA, 968 bp, Homo sapiens
acctaggaagtccagctggcctcacctctcaatcctccctcataacaggacaccccacctgctactgggaactgggtgatgaccactctagctacttcctgctggataggggcaaagaaggggccctgccgttgtagtgtcctccagaggggaactctctaggccagtcaaagggccagtgggtcagtctagcagtcctcggtagaagttgtgagttaagctcatttggggttccatttgtaagaccatctgtagcttgatggccttgatcctggaggaaacaaatttgaggaggaggttaaaaatacagggactgaagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccaggggtaggaggaagaggaagatagaaggaaaaatgaacatcatcccccttgtatttttttcattgtggaaaaatgcatgtaacgtaaaatt

SEQ ID NO: 415389 - DNA, 724 bp, Homo sapiens
gctgggtgcagtggctcactcctgtaatcacagccctttgggaggccaaggtgggcggatcggttgatgtcaggagttcgagaccaacctggccaacatggctacaaccccgtctctactaaaaatataaaaacttagccaagcatagtggtgggcacctgtaatcccagctgctcgggaagctgaggcacgagaatagcttgaacccaggaggtggaggttgcaatgattcaagatcgtgctactgcatttcaacctggacaacaagagcgagactctgtctccaaaaacaaacaaacaaaaaagtattggcactaagactttaacgtgaattttgagagtgatacagtttagcccatgacaagactgatttttttgtctttagtgaataaattaaaatgtatacccagtgactccataaccttaaagcatcttgcccaagctttgttcatttgtccttctacaaacctgcaagtcccaggcaacagagaagaaagcacatcagacttgggctcagggaacccatgtgcttgtgcccctggctaggtctgtcccctcagcatacctgagccacagatacctgtcctgtgaaactgggaaagtaaaaactatatctcacttctctttgtctcaggggtaggaggaagaggaagatagaaggaaaaatgaacatcatcccccttgtatttttttcattgtggaaaaatgcatgtaacgtaaaatt

SEQ ID NO: 415390 - DNA, 416 bp, Homo sapiens
caatagaggtaaaagctggaccccctgggggggcccgggccagaaatttcccggggcccttttttactattattttctcgcccggttcgacgcggccttgaaagaactggagaaagtgaccggaatcccttctcaataccccggcccctctgccgacctcttgcaatccaagtgacatgagccatgggtacgtgacagtaaaggtgagtcagttttgtctctcagtcggctaagtgctctcccaccaggtcacctaaaacgaccagcagagacacccaagaggctgagctgtgaggatcacctgaacctgagcctgggaagtggaggttgcagtgagctgtgatcacaccactgtgctccagcctgggcaacggagtgaaaccctgtctcaagaaaaaaaaaaaaaaaaaaggacc

SEQ ID NO: 415391 - DNA, 236 bp, Homo sapiens
gcggccgcctactactactactgctcgaattcaagcttctaacgatgtacggggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 415392 - DNA, 2267 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagtccttctggaagacaggtcaacggatgtttgcgactccagtccccatgatctgagtctaggtcccagtggagatccatactggggacggcttgttgaccgaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 415393 - DNA, 2283 bp, Homo sapiens
acctaggaagtccagctggcctcacctctcaatcctccctcataacaggacaccccacctgctactgggaactgggtgatgaccactctagctacttcctgctggataggggcaaagaaggggccctgccgttgtagtgtcctccagaggggaactctctaggccagtcaaagggccagtgggtcagtctagcagtcctcggtagaagttgtgagttaagctcatttggggttccatttgtaagaccatctgtagcttgatggccttgatcctggaggaaacaaatttgaggaggaggttaaaaatacagggactgaagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 415394 - DNA, 1577 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaaggtgagtgccaggttcagtgtagtctc

SEQ ID NO: 415395 - DNA, 1501 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaacgaatattgcctggaagtggttatgttaggagactggtaccgttcctggattaactggggctttctcaagcagtgttcatgggcattgactgggggtggcatgcagggatggacattggtctcttataaccccgagagaattagagcggggcacattgatataatccctggacaaacacagaacaacacacaaggacccaccttggggaaaagaatgacaaagaccaaaaccagatatggataacacggcctaaatcgcaagaaacaagaagaggatgacgacagcaagggccacacaacgcgcaagggtagaacataagcatcatcacgaaaacacgcagacaggggaacaacacgacaaaaagaacaagggaggaaatggaacaaccaaaacactcccacagatggatcaacgaggaaacaccacgattggcatacaaaaagggaagaagacagaagtgacaaaaaaaaggaagtggaa

SEQ ID NO: 415396 - DNA, 852 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccaggggtaggaggaagaggaagatagaaggaaaaatgaacatcatcccccttgtatttttttcattgtggaaaaatgcatgtaacgtaaaatt

SEQ ID NO: 415397 - DNA, 881 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 415398 - DNA, 243 bp, Homo sapiens
ttgcaagcagcaaccgtgactgtaccttcctttcccctgcatggatgtggggtctcattcattcattattcccttcctaaatcatgcagggtttgggcagggtggcctgcggggagcagagagaaggcgtccattgcccattgcactagctagagacacacccatctgccttcttccatttacctttctgcctggggtttcctttcagattccccacctgaaaaggggacacattgaggactg

SEQ ID NO: 415399 - DNA, 2105 bp, Homo sapiens
ggcacgagctctctctctctctctctctctctccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 415400 - DNA, 2496 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatgctagctggctgtctttgttcttggagaggtggagtgactgttcacggagaatgcacggcatggggatgaaccctttccctctgcttttgagccctgttctgggctccaaggtgctgtatgatctaggccgtgctggccaggagacaatcctatggggatggcagtggtgtcttgtgctctgtcccctagagcagtcactggccacaggtagccacctgcctttctcccggcttccctagcagagtttgctcaggcacaaatgtgcacctggagcatttgaaatgtgctagtgaggctgaggaagagaattttaaatttcattgaattgt

SEQ ID NO: 415401 - DNA, 1537 bp, Homo sapiens
  misc_feature (44)..(44): n is a, c, g, or t
tcctacttctagacattaaatcggtctcatggatcagcgtgggnttaatggacgagggtacttggaatgtacatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 415402 - DNA, 1050 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaaggtgagtcagttttgtctctcagtcggctaagtgctctcccaccaggtcacctaaaacgaccagcagagacacccaagaggctgagctgtgaggatcacctgaacctgagcctgggaagtggaggttgcagtgagctgtgatcacaccactgtgctccagcctgggcaacggagtgaaaccctgtctcaagaaaaaaaaaaaaaaaaaaggacc

SEQ ID NO: 415403 - DNA, 949 bp, Homo sapiens
gcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagccacagcaaactaatacaaaggcccagagagtttgattttggccgacttgaaggagagacctttcagcagagctgtgctggagtgactgctgtgtgagcttcgcatggtgtcccacatgagcctgggcgaccatcggaggagctgccacagaagcaaataatattaattaaagtccaaattctctcg

SEQ ID NO: 415404 - DNA, 878 bp, Homo sapiens
agcctcgggggcggggaggccgctgcggcgccgagggcgtcttggaggggtccccgcggggccttcggcctgggccgagccggggagcgagggcgccgcagatctttcatcgggataggaccccggggactaggcttttcccgggccgctcgttcctggccggcttgtgggctgcaggggtgggggcggaggaggacgaccctggctggacgctggtcagcatcctgcttgtgagaccggttccgcggtccgcagcgctggtggctgcaaggtttgtgtacggacgcatctgtcggctctcgtatttaaaaacgacggcttctgccaaaagagaaaagccatatctgccgacggacgctcgagagataatcgtggaactttatcagcgatggggctgttggtcacctttgccctccctctcttttcttttttcttaatcttttattttcgttttttgggagatgtcagagggcctttccctgttaggatgacttttatctttgctcttgtaatggctcaagatagttgggaggtaatttgcattcactttatgcatacccaccttgaaaaacgtattttggttcgcctgaaactgttgttggtttgagcataatttatgtttagaaagacaaaaagcaattgtcatatctccaaagaccaaagacatagctgatagctgtatgcattactggtaagttaaagaaagattttttgtgtgaaaaattgactgagatcttaatggggataggaaatagaatgctgataggtcgactgtgtctatgagtagaggcgcctagtgaaaacaagcttggagtggatgagtaggagttcaacaggcaccagagagaggagggcatttcaggcagagggtgtgaatt

SEQ ID NO: 415405 - DNA, 406 bp, Homo sapiens
aaaaatcaaatccagaataatcttcacttttaataaactatgggccagaccactgaggataaacacatgaacattattcatgtcctcaaaactttaagggaaaaaagggaagggtcatcttggaacaaaaatttaggaaaagggagaggaagcaaatttaaaatatattaaataatattctacatatacacacaaacacggagcgaaaagtcaacaggccttattatttgatgagaatcaagaatgtctccgaggtatctagctgtgaagccgaaacccgatgctctcaacagctaacaggacaagctaagactatctatcctatcactaaaggttgactcattatcaacttggtaaatctaacctgaacacaaaggtggatttccagagatgtcttgggccatct

SEQ ID NO: 415406 - DNA, 408 bp, Homo sapiens
caggctggagtgcattggcgcaatctcggctcactgcaacctctgcctcccgcatccaagcaattctcctgcctcagcctcccgaatggttgggactagaggcacccaccaccacgcccagctaactttggtatttttagtagagatgggatttcaccatattggccaggctggtctcgaactcctgaccttgtgatcctcccacctcggcctcccaaagtgctgggattacaggcatgagccactgtgcccagcccaccccatacagtttcaaaaggacttctctggccctattgtttcaatcactaatattacctacctagtagcctgcaaatcatggtgatcccctgtccagcaacaagaagggcacaggtgcagcaatctgtggtcactcactcctcgatcttg

SEQ ID NO: 415407 - DNA, 409 bp, Homo sapiens
aaaagtctcggtgctatcctgattctttttttccctttcacttcttccaccccatccatcagcaagtcctattcacactaccttcaaaatgaaagccatacaaatctacttcttcctacctctactacgccaccttggcccaagcagccatgatctctcatttggacaacagctttttctcttgccccagccaattttctctctaaaccaaacccagaataattttctttaaaataccgtttgtcctttccctgtctgcagccctccaatgattctgccacacacagaatgcaatggaaactctcaatctcagcatacacagccttccaggatctgctccctcctctctctccaacctcactctgccactcccaggccgaaccacactggctgccttctgcctctgtgg

SEQ ID NO: 415408 - DNA, 441 bp, Homo sapiens
atgccaagtaaaataatgcaatgtatctctctctgcgtatctgctcaccaggaggcatagtaacacaagagacagtacagtttttcacttgccacgtaacaatttttgaaaacatggaatggagaaattttacatcagagtagttcactagagaggaaacggagggaggctatttgcctagtgctttcctgcctcctgcttcccatgagatcacatgatgcagaacatttggaaataatcacctctttcacttctgtgtgatgatgtccagcctctgggtgactggtcagtaagccatatcctataacctgtagtatgatatttcatccatgtctaaaaatgggattgaaatgaagttctgagaggtgggatatggaccaggagaaagaggaaaggaactagttggaagaatattcctaacatagaaccttttcatttaaa

SEQ ID NO: 415409 - DNA, 990 bp, Homo sapiens
agctttgctcaccgtgattttcaaggacacatcttgtgctcttccctgcctgccatccagactatacccagtcagggtggcaggagctgctgccccttcctccctgagtcctggtcgtgggtggtggagatgtgccatgacgctcacggaggcatgctcaccccttcctctgtggcagaggggatggctgcacgacagctcttccctgtcctttccaaagcgtctgtggttccactttttggggcaaagcaggaatactggaagagagagaaagtggtcctttctatagtaataaagttgacattgattcaagttcatgcttggggaaaggacagggctactaacaattataatgctgggagcaatggaattttctcatgggtatgtggtaggtttaattttaattatcccagttaattcttagaactgctctgtgaagtatttcccgctttgtgcttaagttctaaaagatcctgtgccaaaaccaagaatgaaaacccaagcattctttcttgcccatcgatctttctctcatcaggccacttcttgggttgatagtggtgagtgtagccgctgccactttcagaatacccaccatgggccccagtcactgtgtggcgtggagaagagatggttctctctgtgtcatagctgaacaagcccagcccagagaggtttctgccctaggagctctcgatggtggaattgggatgcgatcccacatcctgcctgttttgaaaacagcattctttatttccaattcctgcttccattgttccttttaatatttctttgtttagctcacaaaaacacggcttgcggagctgctgcgtgcagctgtagctgtttctctgggtgcagcctgcatccgccttcctgcccgcctcctttcctgcactgccatcgtggtctccgggcacttggtccctttctcttcccctgagtccctttggctcccctgtgccacccttgtgatccacaggctctgcc

SEQ ID NO: 415410 - DNA, 480 bp, Homo sapiens
ttgtatcatacgcatcgacctcaacagtttcttccaggctatttgccattcttgattgaatagactgttaccaaggtcactatgcgccaaatccagtgatcacatttctgtcctcatttttttactcagcggtagcaagtcacaaagttgacagttcttttcttcttcaaacactttctgctgtggcatcatgatgctatgttctcctccatacctactgctcttcttggcctttcttgctgacttctgctctgttggcttccaaatgctggtctgaaagactgtaatctttctgaaggtgattcagtactgtggcgtttaatgccatctaaatgctgatgaatcccaaatgtatatctctaatcctgatctctgcaatgagctcctaatttatgtaaaaaaccctctgcttgacctttccactgggatgtctaagagctatctcaaacttctcaagaccaaaacagagctatccattct

SEQ ID NO: 415411 - DNA, 632 bp, Homo sapiens
aataattacaagtgctatgaaggaagcagagtgctgagacttacagaatttagacaaggcaaggttcttctctgctttaaaccttccagagctccccatgggctgtgcaatgcagttccaagtccttagcatggcattcaaggctctttaaaacatcacatcttgcctgatgttcccggccactgatgctctcaatactccaggcacaactaattactggccactccctggacatgtgtgttgtgccaaggagctcagatattgacctgtcagtgataggagtggttctaagcatggtggtgacacattctcatccaatgtacactgtggatggtaattctgcagtctgtaagagggcctggtcagggagagacacgagaacctgttagaaagcatcaatagggcttcagcaagaggatggcgtggcctgacatgtgagtgggaagcacagatctatgagatactgaagtgatccattctttaagacttggtcatggattggctgtgagggcgaggaaaaggggatagcaaatgacttccagctcctagccttgaacaggttggtgagctgcagactgaggcagtaaaagtcacagaaaagtggtcttaacgtagtaacactcctttaatca

SEQ ID NO: 415412 - DNA, 659 bp, Homo sapiens
tgtctgttttgttttaaccatttccagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415413 - DNA, 996 bp, Homo sapiens
caaaaatattatgtgtaatgatagaattatgtttttaaaactatttattaaaaaagtttttagaaatatatgtgagtcagaattctagacatgtattttctccctttctttttttctttctctctttctttctttcttttgcctggcaataaatttttgcttcatttttatgatgtagacatgtattaaagtaggaaagaatatttatgagtgtattttaatagatttagtctctctctctttctctttctatatatatatacatatatgtatatatatgtatatgtgtgtgtgtatctatatatatatatatatgcttttgtaatgtttttctccccgtaacacagtattttatgaataccaagattcatttttataggggaaaaaaacatactttctactgctgaaatgtttttcatccctaggtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaataggtaatctggttcctaggcctcgtttggaattttttagtatgaaacctagagaaattagcctggtatagattatgaaagtaccgctaaacacagttgccatttattcccccatgtccaattcagagcaagggtaacctctggcgttgtaaccgaaactgctctctgtaaactttaaattttttttgaagaatggtattttttttcttaaaaggtcatataaattttatatagatatgtttgtcttaatattaaaatatttaaaatcatatattgagaaagttgatattccatgaggatgcttcatttggctttgaaaactccatacacattcatgctcagtgtgagaggaatgatggtattctattttatataattgtttattctagagttatctgaaagctaatacttcatactt

SEQ ID NO: 415414 - DNA, 775 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcagtgccagggaatttttcaaaagctttgaacctttgggcaaattccccaaggccaaaaaccaaagtgcaaaaacctttgggcgcattgcgcacggccgacattagcgcccaacccaattttcttctttcccaagaaagtttccctttgggccggattgcacaggttggtggggggcacggtaacgataaattgggcacccacattggaaaccaaaaaaggacaacagttttttaacaaaaatttttccttccttaggcgaactttggaacgggccaacaaggaaacacgggcgggggggttttttaacacaccaaccgggtttggcggcaaacacttgggcttcaactttgtgttttcgggcttaacacaattcacggcaaaaaacgggtttttaacaaacaagggggtttttttggggcccaaaaaaacttttcccaaaagggaaacaaggcggcacccaacacgggaaaaaaattttaaaaccccccttg

SEQ ID NO: 415415 - DNA, 441 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcagaatttaaattgcttttgttcattttccatactactccccacacttcatcgccaggactctgaaaaatggtggctatccctccatgccaagtttgacttgttttgccttgggaattgccaaagtcaagcttaaaatcctgcaggcgggccacacaga

SEQ ID NO: 415416 - DNA, 861 bp, Homo sapiens
gggcaaatttggtgatatatgttggtaggatactctacagacataaaaggagagagaatattataacccacatgtagccatcacccagcttgtctctaagtaaaaatttatgtgtatgtaagaagactgggaagtaatttgcaaaaatgaaaacaattgtgttcaggcattggggttatgggattttttttccttaaactttttgtttttgttaagatgtctatacatattcagtgtatgtttcatttttaaagaaaaatatttaaaaaacataatccttgggatctgggtcctgtctgtttaactttatattttccacagcttcttatgcatagaaggaactcagtttattgaatgttttaattgcatggagttcaaggtaaatcctttttattttgatgagggaaatttggattcaagtggatattgatcatatcactttgatttcctttgtaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagtaggtggcttctaattataagttaaacagtaattaattcagaaagcagattgtatgtgaggatgtgtacctgtgtgttagtttttcaaaaccacatactacagacatattcattatacttttagagtcaacataaaaggcatgataatgtgagtttgctaaaaggtctagaaaggctatattttctgataaagatttggggggatgtttgtaatctcttatgtaaaagatggaagcccttatttttcattctattgtc

SEQ ID NO: 415417 - DNA, 826 bp, Homo sapiens
gggcaaatttggtgatatatgttggtaggatactctacagacataaaaggagagagaatattataacccacatgtagccatcacccagcttgtctctaagtaaaaatttatgtgtatgtaagaagactgggaagtaatttgcaaaaatgaaaacaattgtgttcaggcattggggttatgggattttttttccttaaactttttgtttttgttaagatgtctatacatattcagtgtatgtttcatttttaaagaaaaatatttaaaaaacataatccttgggatctgggtcctgtctgtttaactttatattttccacagcttcttatgcatagaaggaactcagtttattgaatgttttaattgcatggagttcaaggtaaatcctttttattttgatgagggaaatttggattcaagtggatattgatcatatcactttgatttcctttgtaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagtaggtggcttctaattataagttaaacagtaattaattcagaaagcagattgtatgtgaggatgtgtacctgtgtgttagtttttcaaaacccttcttccgcactatttcttttcctttataggtacaataaaagcttataatgtgtgttgtttaaaggtataaagggtctatttttttgtgattgggggagtttgtaactcttattgaagggcctttttttt

SEQ ID NO: 415418 - DNA, 1224 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtattatgatgcggccgtgccttatctaaaatttatatcccccgtcgccgcaccata

SEQ ID NO: 415419 - DNA, 1216 bp, Homo sapiens
  misc_feature (1214)..(1214): n is a, c, g, or t
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtattccagatgcgggccgctttcccttttagtggaggggttaattnct

SEQ ID NO: 415420 - DNA, 1053 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415421 - DNA, 1946 bp, Homo sapiens
  misc_feature (1082)..(1082): n is a, c, g, or t
gtttcatactgtgaaaaggcatgaagatttctgtaattgttacatatttttgttgattttgaaagtacttgaattcagtttttaaagaacaattatttaagatggcaggtgaatcagtaaataagtaatactttgtaaaagcatctgaggacatgttagaaatgctttgatactttttatgactagagctctcagagttgtgtggcagagcatttcatacaaagaaaagttgcagaaaagagtaggccttgagaagagagggttatctgacatgctcgatactttacctcacttgtgaaggagaaagagccatcctctctacctttgttctaggtggatattctcttgctgtcagaacaccatccatttttgtagcccaaagaacaatgtttccatagtataaagttgaaaaaaaaaacaaactatattgaagcctctttaaagacaagataaatacagagagttatgttaggagtataacaagtaatattatgtctcaggccttctaattgaaatgctaagctaagcttacttttttttttttgtaacggagtctcgctcttgttgcccaggctagagtgcaatggcgtgatctcggctcaccccaacctctgcctcccgggttccagtgattctcccgcctcagcctcccgagtagctgggattacaggcatgcaccaccatgtcggactaattttttgtgtgttttttttttagtagagacaaggtttctccatgttggtcaggctggcctcgaactcctgacctcagatgatccacccacctcggcctcccaaagtgctaggattataggtgtgagccactgcacccggcctttttttttttctttttgagatggagtcttgctgtctcccagcctggattgccacagtgcaatctcggctcactgcaacctcctgacctcaagtgatccacctcagcctcccaaagtgctgggattacagatgtgagccaccgtacccagcctaaatgctaagcttacttttgatgtggtaaatttatatattctctatcccaaatacatagggagcaagtatgttcagatgtagttaaatgtttantcccatacaccatcttgactattataaaaagaccttacccagtgagctaaattggctaggtcaaatgtggttaaaatttggctgttctggtttcaggcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415422 - DNA, 1370 bp, Homo sapiens
gggcaaatttggtgatatatgttggtaggatactctacagacataaaaggagagagaatattataacccacatgtagccatcacccagcttgtctctaagtaaaaatttatgtgtatgtaagaagactgggaagtaatttgcaaaaatgaaaacaattgtgttcaggcattggggttatgggattttttttccttaaactttttgtttttgttaagatgtctatacatattcagtgtatgtttcatttttaaagaaaaatatttaaaaaacataatccttgggatctgggtcctgtctgtttaactttatattttccacagcttcttatgcatagaaggaactcagtttattgaatgttttaattgcatggagttcaaggtaaatcctttttattttgatgagggaaatttggattcaagtggatattgatcatatcactttgatttcctttgtaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415423 - DNA, 1078 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtattatgatgcggccgtgccttatctaaaatttatatcccccgtcgccgcaccata

SEQ ID NO: 415424 - DNA, 1355 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaaggtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaatagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415425 - DNA, 962 bp, Homo sapiens
gtgtagctgcagcgactctcttataataccaccgttacagcgcactttaactttagacgtggggcaattcataatgcctaactcactgactttcgtgatcgtcagggatatccactattgttaacagtcttaggctatcgaaaaggcgggaatactgtggtacacgaacacaagggtttacattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415426 - DNA, 1145 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaacatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415427 - DNA, 917 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415428 - DNA, 1213 bp, Homo sapiens
caaaaatattatgtgtaatgatagaattatgtttttaaaactatttattaaaaaagtttttagaaatatatgtgagtcagaattctagacatgtattttctccctttctttttttctttctctctttctttctttcttttgcctggcaataaatttttgcttcatttttatgatgtagacatgtattaaagtaggaaagaatatttatgagtgtattttaatagatttagtctctctctctttctctttctatatatatatacatatatgtatatatatgtatatgtgtgtgtgtatctatatatatatatatatgcttttgtaatgtttttctccccgtaacacagtattttatgaataccaagattcatttttataggggaaaaaaacatactttctactgctgaaatgtttttcatccctaggtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaatagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415429 - DNA, 1138 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaaggtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaataggtaatctggttcctaggcctcgtttggaattttttagtatgaaacctagagaaattagcctggtatagattatgaaagtaccgctaaacacagttgccatttattcccccatgtccaattcagagcaagggtaacctctggcgttgtaaccgaaactgctctctgtaaactttaaattttttttgaagaatggtattttttttcttaaaaggtcatataaattttatatagatatgtttgtcttaatattaaaatatttaaaatcatatattgagaaagttgatattccatgaggatgcttcatttggctttgaaaactccatacacattcatgctcagtgtgagaggaatgatggtattctattttatataattgtttattctagagttatctgaaagctaatacttcatactt

SEQ ID NO: 415430 - DNA, 1050 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcagggtgagtgccccctcccgcgctacccacgccggggccgggatgcccagaaggcgcttcctcgggggcacacgtggccgatcgggccaggaatgcagttcttcttgatgagggtactaggacgcggcttccgcctcctgggcgggtccacctcctccgctgcgcccactgcccggccctgcccgggccacggtgccctctcgggctgcctggagctttccccctcctggcctttgcaccggctgctcggtctgcaccgatttggcctctcgtccactaacttaacagattgcatacagttggtacttctggagagtcttctctgacccgtgtctgggaattggttgccttctgttctgtacataacctttgttacagcacttctcacctggcattgtgaaaatccgtttacctgcctttcgcgcctcatctaagaggtcctgaaagctgggatcatgtcttatttgtaataatgctgtgttcagttaggtcaaggggctgcatgaactataaccagtgttggtaaatcattgctcttcagcccagtccattcattcatttagtacatattcttccggcacttaacactaagggtataaacatgattgagtaaagtggctgtttcgaggaactctcagtctgtaggacagaggtgcaatagattatgttcaaaacctttttgacagcgtcgaatgagacaaacatgatctctgctaacatcgtgagttcttagttgcaagcaacagaaactggctgatttaagcaaa

SEQ ID NO: 415431 - DNA, 1199 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415432 - DNA, 1664 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtattaaaaaaaaaaaaaaaaaaaaaaaaaaaaaaaaaaaaaaaaaaaaaaagggggaggaagatcaaagattttccatagggggggccaaggttaagacatacacaagtccgtgtacacacaggggaccaaatagggagaagaacaatacaaactacgccacggacgcggtgcaaccaaccgagagacgcggaaacagggcaaccgagaaacctggcatagagcacctgattaacatgaggagccggagacaccacagatggcggcacacacctgccgtccaccaaccagattctaaaaccccctcagagggtcgcacacattcaaacatctttacagcggaatcaattggcggttgattccaccaagcgagatctatagtctggatgggccgaaacagatatgaggctcccgcgcgccaagcgtcagcaaatacattttggcggtcgcacgtgtgacagagcagtacatgcgcggagcgaacaactaccgacctg

SEQ ID NO: 415433 - DNA, 1063 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgaattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415434 - DNA, 1219 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaatagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415435 - DNA, 691 bp, Homo sapiens
  misc_feature (16)..(16): n is a, c, g, or t
acccccttcctagccntcttacctacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaa

SEQ ID NO: 415436 - DNA, 771 bp, Homo sapiens
gaccggcccacgcttcccgccagtcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaaggtaagctatttacagactggtggtgattactttttaaatttcactgagagaaactaaagaatatattgtttttaaaagactttaggcccaacgtggtggctcatgcctgtaatgccaccactttggaaggctggggcgggcagatcacctgaagttaggagtttgagaccagcctagccaacgtggtgaaacctcatctctact

SEQ ID NO: 415437 - DNA, 4029 bp, Homo sapiens
cagtcaatcagcggcagagctgagaagggcacagccgcgcggcggagggcagagtcagccgagccgagtccagccggacgagcggaccagcgcagggcagcccaagcagcgcgcagcgaacgcccgccgccgcccacaccctctgcggtccccgcggcgcctgccacccttccctccttccccgcgtccccgcctcgccggccagtcagcttgccgggttcgctgccccgcgaaaccccgaggtcaccagcccgcgcctctgcttccctgggccgcgcgccgcctccacgccctccttctcccctggcccggcgcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggataaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgaaggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacgctgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattctg

SEQ ID NO: 415438 - DNA, 873 bp, Homo sapiens
cagtcaatcagcggcagagctgagaagggcacagccgcgcggcggagggcagagtcagccgagccgagtccagccggacgagcggaccagcgcagggcagcccaagcagcgcgcagcgaacgcccgccgccgcccacaccctctgcggtccccgcggcgcctgccacccttccctccttccccgcgtccccgcctcgccggccagtcagcttgccgggttcgctgccccgcgaaaccccgaggtcaccagcccgcgcctctgcttccctgggccgcgcgccgcctccacgccctccttctcccctggcccggcgcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatggtatgttattcaagtcatatgtaagaacc

SEQ ID NO: 415439 - DNA, 381 bp, Homo sapiens
  misc_feature (37)..(37): n is a, c, g, or t
  misc_feature (41)..(41): n is a, c, g, or t
  misc_feature (89)..(89): n is a, c, g, or t
  misc_feature (103)..(103): n is a, c, g, or t
ttgacgtcaagctggggaaaagatttgagctgggagncctnccttggcccactctgcctcatgggtcatcgcttccatttttaagacgncttctgccctggtntcttccttcgaggcagctgcttcagagggaggggtgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccttgttcaattcccacctatgagtgagaatatatggtgtttggttttttgttcttgcgatagtttactgagaatgatgatttccaatttcat

SEQ ID NO: 415440 - DNA, 454 bp, Homo sapiens
tgggttggattgtttccaataggtggcccgaatgtttccccttctcaacatttagtactccactaaacattcctctaaattgtatgtcacacctttctactttctagggatctaccacagctctcaactgtcaggtttggaaaggacctttaaaagctccgatctgggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctgctcgggaggctgaggcaggagaatggcgtgaacccgggaagcggagcttgcagtgagccgagattgcgccactgcagtccgcagtccggcctgggcgacagagcgagactctgtctc

SEQ ID NO: 415441 - DNA, 288 bp, Homo sapiens
gaaagtaacagcatggatttcagctatggtgctttatcctaaaaggagttgcaggtttcattattgcctgttgatattaattccaaaaatgtcaagttccccagttgggacaatgaacagtcagcaaccctgagaacgaaggcatatccaaatgtgaccacaggagtattgggtaggtgtaactggagtctaaccccacatgtttgtggtagacagtcatctggaactctgacctagattacttagaatctgtgggaaatccaggctatgcccataggcctcagtgcc

SEQ ID NO: 415442 - DNA, 338 bp, Homo sapiens
catctgtcaccccctccgctacaccactatcatgaaagagggactgtgtaacttactagtcactgtgtcctggatcctctcctgtaccaatgccctgtctcacactctcctcctggcccagctgtccttttgtgctgacaacaccatcccccatttcttctgtgatcttgttgccctactcaagctctcatgctcagacatctccctcaatgagctggtcattttcacagtgggacaggcagtcattactctaccactaatatgcatcttgatctcttatggccacattggggtcaccatcctcaaggctccatctactaagggcatcttcaaagctt

SEQ ID NO: 415443 - DNA, 477 bp, Homo sapiens
cagttttctacaaggtgaatttatttcccatcaacttctgctataaaatcggaaatatgtttccagggggaatattatccaattaaccatgttgaaggttttagcaaaggcagtgtaagatagagtggggcctgtagcattgcagggagagtgtctttcacttggaattttgttttgcagcacatattacagtagttttgctagtcccttttctccagaccgtagggatttctctcaataagtattcactatttctctaaattttattctatttttttgttgagcagggaatagaaaggattacgatgtaaaatttctgggaggattaggtagctatctcctacttcaccagtaagtgaagtgcctcacatgagccatcccaaagattcattattccaaaccttgggtttggcagtataagtcacaggcctacctgtttatgaaaacttacttacttaaaataagagctacttttgg

SEQ ID NO: 415444 - DNA, 112 bp, Homo sapiens
tgccttgaatatcaatctggccccccagatggtcataccacaatcactcttaccttcttccaatctttctcttctccccaaccagaatgattctttgaaagcttcagtatga

SEQ ID NO: 415445 - DNA, 657 bp, Homo sapiens
caccacacccggcctcaatcctgcctttcactaacccatacatatcatacataaggtcagtaaaaaataaggtggcgcggggcatggtagctcacatctacaattccagtgttttgggaggccaaagcaggaggaatgcttgaggccagaggttcgagaccagcctgggcaacatagtgagaccccatctgtataagaaattaaaattacaaaattaaaaaaaaatttttaaagatggattttgccacaacctgggaaatttctccagccaaagggttgttgtcattttagggcatcaaaggccttaataattttatgtttgggtcaaaacctcttgggaactcatctttaagaacagcattcagaattaggtttctaagtgactcaataaaaggagtccttgtccttcacaaactctcctgatcacatatagtattgagtggctttgtcacttgccttagtcttgggccttagctctgactcttattcctaaaaggaaaaattaagtccattctcagtaggtgaaaacctatcataggccgggcacagtgggtttacgcttgtaatccccgcactttgggaggtcgaggcgggtgggtcacttgaggtcaggagttcgagaccagcctggccaacatggtgaaaccccgtcactac

SEQ ID NO: 415446 - DNA, 1967 bp, Homo sapiens
gatcagccacagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415447 - DNA, 2939 bp, Homo sapiens
  misc_feature (49)..(49): n is a, c, g, or t
tacgactcgagctgagaccatgtcccctagcggccatacaatgaatttngcttacacgtctttaatttcttttactgcctcatgtccagttctatgagatgggagtagatgaatggctgtcctggtgttgaagtccttacattttacttctctttaaaaatgaaaacaaaaaaaaatgtcgcttgtcagaccacacaaagccacacaggcttataacagagctcaggaatcttctgtcctttccagagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggagaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415448 - DNA, 2990 bp, Homo sapiens
gaggaaacagattcagagaggtaagctacttacaaaggtcacacagctaaaaggtgctgggatcaggaactctgtctcaaaaaaaaaaaaaaagaaaagaaaagaaacatgcatcctattcctagctgcctcatgtccagttctatgagatgggagtagatgaatggctgtcctggtgttgaagtccttacattttacttctctttaaaaatgaaaacaaaaaaaaatgtcgcttgtcagaccacacaaagccacacaggcttataacagagctcaggaatcttctgtcctttccagagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggagaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415449 - DNA, 2485 bp, Homo sapiens
ccgcgcgtggcgagtctgtgtcctccctgtcccccagagcagacaccctctctgtgtctggaccggggaggagcagacgctggacaggtttctggtagaatgctggcaatttccaggaagatacgtggagaacggaaaggttgctacacccaaatagtgaagcaaaggctatgattatggaggattggacctgcaaactccagaacagagcaaccttgtaaaatgtgtgtgggcagcacagagaacttgggcaagttaacagtttcctcatctgtgaatactgatttatggaaagcacctggtgcgtgttctgccctctgaggaccctgccctttcccaaaaggggtatcttaagaaggaaaatatggctgctctttgcggacagcagagtcccagaaccccatgcaggtgtttcagggctttatgtcattcaaggatgtggctgtgaacttcactaggaagaatggagagaactggaccttgctcagagagtcttgtacagggatgtaatgctggagaactataggaacctggtctccttggtaggatttccattttccaaacctggtatcatctcctagttggaagaagtggtaagcccacgaacacaaatgcaggagggagaggtgccaagaagcagcggtacacaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415450 - DNA, 2029 bp, Homo sapiens
gatcagccacagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggctccttgaatgtattgaggcctctcctctctgtactgtttctgcttgtcatcattttcatggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415451 - DNA, 2095 bp, Homo sapiens
tacctcttgaaatatgactatcaagtagactgaatacacacattgctctggtaggaaaatcaatttcggaaacttgactaacaatcccggagtgtcagagttgtgagggatctcagaggtcatagaggaattcactctctcatcaaatggatgaggagaccaagttaatacgtaaatcctttttccaggaacctggaattcacatgagaataaaggattccttttacaatagggaactgctccctaatatatgtgtttctcaagctgacatttctgtatgttgagtttctatcaagttgtatgcctcactaagaaatgtttggctgccttccacccccaccccctgccaggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415452 - DNA, 1876 bp, Homo sapiens
gtgtttaaattgtcaaaaaacaagtactgacggaatgaacaaagcaagaatgttctttattttttggtccccagtctggactgtgtattggagctgttcatggccatctagtacatcttgatttttaaaatcccatgttctcacttgttttttttaaaatcccacttattctgagggtctagcagctagagaagtgctttctattttgttagaccctgagcttgacacttcacatgtactttctttgtgaaggacacattaccgtcagcccattttacagatgcaaaaagtgacttaatgaggagagaagcccgagtttagaaatacagaaaccacagcaagttctgctgtttccttttctgcaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415453 - DNA, 1801 bp, Homo sapiens
gatcagccacagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415454 - DNA, 989 bp, Homo sapiens
cccggaggtcgcgcaaggtctgggatatggctcctggagtctagggagcagtcaccaccaaggacggtgctggcttctcgggttcctctcccagatctacaatccggatggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415455 - DNA, 1802 bp, Homo sapiens
  misc_feature (49)..(49): n is a, c, g, or t
tacgactcgagctgagaccatgtcccctagcggccatacaatgaatttngcttacacgtctttaatttcttttactgcctcatgtccagttctatgagatgggagtagatgaatggctgtcctggtgttgaagtccttacattttacttctctttaaaaatgaaaacaaaaaaaaatgtcgcttgtcagaccacacaaagccacacaggcttataacagagctcaggaatcttctgtcctttccagagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggagaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatgtaaatgtcacactgtgcccagaatggatgaccaggaaccttaaagagtggctgaaaagattgcagagttatcataataaattgctaacttgcgtatttcctatgtgccaga

SEQ ID NO: 415456 - DNA, 1014 bp, Homo sapiens
ccgcgcgtggcgagtctgtgtcctccctgtcccccagagcagacaccctctctgtgtctggaccggggaggagcagacgctggacaggtttctggtagaatgctggcaatttccaggaagatacgtggagaacggaaaggttgctacacccaaatagtgaagcaaaggctatgattatggaggattggacctgcaaactccagaacagagcaaccttgtaaaatgtgtgtgggcagcacagagaacttgggcaagttaacagtttcctcatctgtgaatactgatttatggaaagcacctggtgcgtgttctgccctctgaggaccctgccctttcccaaaaggggtatcttaagaaggaaaatatggctgctctttgcggacagcagagtcccagaaccccatgcaggtgtttcagggctttatgtcattcaaggatgtggctgtgaacttcactaggaagaatggagagaactggaccttgctcagagagtcttgtacagggatgtaatgctggagaactataggaacctggtctccttggtaggatttccattttccaaacctggtatcatctcctagttggaagaagtggtaagcccacgaacacaaatgcaggagggagaggtgccaagaagcagcggtacactgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415457 - DNA, 995 bp, Homo sapiens
  misc_feature (49)..(49): n is a, c, g, or t
tacgactcgagctgagaccatgtcccctagcggccatacaatgaatttngcttacacgtctttaatttcttttactgcctcatgtccagttctatgagatgggagtagatgaatggctgtcctggtgttgaagtccttacattttacttctctttaaaaatgaaaacaaaaaaaaatgtcgcttgtcagaccacacaaagccacacaggcttataacagagctcaggaatcttctgtcctttccagagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccatgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcctatgtgccaga

SEQ ID NO: 415458 - DNA, 1487 bp, Homo sapiens
  misc_feature (49)..(49): n is a, c, g, or t
tacgactcgagctgagaccatgtcccctagcggccatacaatgaatttngcttacacgtctttaatttcttttactgcctcatgtccagttctatgagatgggagtagatgaatggctgtcctggtgttgaagtccttacattttacttctctttaaaaatgaaaacaaaaaaaaatgtcgcttgtcagaccacacaaagccacacaggcttataacagagctcaggaatcttctgtcctttccagagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggtgagtgcttggggaccattcatccatttgggagagggcggtgggggatggtgtgcccagctggctgcagctgctaggtccactgacgccactactatgctctgagcatacctgaaaaagactagcttcagcgtctgcctgctgggtcagtgtaaatatacattgcacttggttttggaaactgtgtggagtaggttgctccgtccccatctctgtcccactgtctctgtgcgatctctgtctgtgtctgtctctcctccttcttgctagtttcctgctgtgccttatacagcttttggtgatgtgtgtttgggtggagggtgcagaagttgtgggggcttagggcggtgatatgtccctgtggctggatctgcatggcacatcc

SEQ ID NO: 415459 - DNA, 768 bp, Homo sapiens
ccgcgcgtggcgagtctgtgtcctccctgtcccccagagcagacaccctctctgtgtctggaccggggaggagcagacgctggacaggtttctggtagaatgctggcaatttccaggaagatacgtggagaacggaaaggttgctacacccaaatagtgaagcaaaggctatgattatggaggattggacctgcaaactccagaacagagcaaccttgtaaaatgtgtgtgggcagcacagagaacttgggcaagttaacagtttcctcatctgtgaatactgatttatggaaagcacctggtgcgtgttctgccctctgaggaccctgccctttcccaaaaggggtatcttaagaaggaaaatatggctgctctttgcggacagcagagtcccagaaccccatgcaggtgtttcagggctttatgtcattcaaggatgtggctgtgaacttcactaggaagaatggagagaactggaccttgctcagagagtcttgtacagggatgtaatgctggagaactataggaacctggtctccttggtaggatttccattttccaaacctggtatcatctcctagttggaagaagtggtaagcccacgaacacaaatgcaggagggagaggtgccaagaagcagcggtacacgagaaagacagggctggagaccagtttgctgatagtgaccccaaaccagaaagttcattgggcctgcacctccagtagaactggacctgaggcagctaggaataggatgcatgtttctga

SEQ ID NO: 415460 - DNA, 455 bp, Homo sapiens
ttcaaggaaaaaacatgttttacaacttgagtttatctgcctagtgaccttgcagctgcagagctagagaaacagcgtcttcacaatgcctgggaaagggagagaaaaggctcactggccacagaaaaacaagcagttaatttttaaaggacttcagctctttctcttcctcagggggaattgggttttcttacatacaatgaatttttgcttacacgttctttaatttcttttaattccttttccagtagaactggacctgaggcagctaggaataggatgcatgtttctgaccctggccaggatcagaaagaaggaaacctctcctgagggtcttcagcagtggaagagggcagtcaggacagggacagtgaggaaacgttacatcgctaaaaagggctacttatgcgtattctatgcgtggttgaaaataaacagcactgtgtctggaatga

SEQ ID NO: 415461 - DNA, 230 bp, Homo sapiens
  misc_feature (15)..(15): n is a, c, g, or t
cgcagcgcggtgacntagaggatccccagccacactgcgcacgtgcagtcattctgaaaggacctttccctgtacttacctttcaacatgcttcaatcttatcaacgctacattttgtatttttcaaacaagtataaattctgcaataaagagatgtagttttttttttttttttttttttttttttttttttttttttttttttttttttttttttttttttttttttt

SEQ ID NO: 415462 - DNA, 336 bp, Homo sapiens
  misc_feature (41)..(41): n is a, c, g, or t
ggtccatcagtatggttaactataccttttatctagagggnaaaatcaaatcaactataccttttatcgagaaggaaaatcactaagttttattcaggctctaccaacccccattatatctactgtttgtttatgtcctaaattaacctttcatcctatgaagtaataaagttcattttaaaccaacgattaccaaatgcatttttttcaaaggaagggcaaaaaccaaatggcactgttttctctgaatggaaatctgtaagttagttaaaatgtttatacttcattttaagaccaaacaccaataaggacttctgaaaaattgttccttttttc

SEQ ID NO: 415463 - DNA, 2349 bp, Homo sapiens
cacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagttttttttt

SEQ ID NO: 415464 - DNA, 2680 bp, Homo sapiens
cacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaagattgagtttttgtttgttatttctgaatggttcatcagtatgttaactataccttttatcgagaaggaaaatcactaagttttattcaggctctaccaacccccattatatctactgtttgtttatgtcctaaattaacctttcatcctatgaagtaataaagttcattttaaaccaacgattaccaaatgcatttttttcaaaggaagggcaaaaaccaaatggcactgttttctctgaatggaaatctgtaagttagttaaaatgtttatacttcattttaagaccaaacaccaataaggacttctgaaaaattgttccttttttc

SEQ ID NO: 415465 - DNA, 2411 bp, Homo sapiens
cacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagttttttttttttttttttttttttttttttttttttttttttttttttttttttttttttttttttttttt

SEQ ID NO: 415466 - DNA, 176 bp, Homo sapiens
caaaacagatcagcttcttaaaatatttttccacattcccttctggttcatcataaattctgttgtctagttaggaacaaattatacatatacctgatcataatttattttctgcacataaacttatcagacaaataacaagcaggctgattttatttaaatctaccaagacattt

SEQ ID NO: 415467 - DNA, 327 bp, Homo sapiens
ttccgtttgtctcgccaaaccagttttgaatacagagccttcacctctagttctaaaccatagctctctaaagactcaaccttcgttcctccttccttacagcccactcagctacatctgttctttgctactcaggttaacactgcctcggttagaccttctctgattgtccagactgggttatatctccattgtaagttcccatcaaaccctgtccttctcctttgcagcattgtttgtttaatagtttaccaaccagatagagaagacaactcatgggcatgaggtcatgtgtgatgcttgcgcactggtgtatccctaacgtct

SEQ ID NO: 415468 - DNA, 6277 bp, Homo sapiens
gttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggaagcacccagaatccagacgagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtcacaactccagaccctcagtgatgcccacagaaaagcctatgagatttaccacgaaagctatgcttttcagggcggaaaactctctgttgtcctgcgagctgaagatatcccggagctcctgctagaaccacccatatctgcgcttgcccaggacacggtcgatttcctctctcttgatttgtcttatgaatgccaaaatgaggcaagtctgcggcagaagctgagtaaattgcagaccattgagccaaaagtgaaagttttcatcttcaacctaaaactcccagactgcccctccaccatgaagaacccagccagtctgctcttcagcctttttgaagccataaataaagaccaagtgctcaccattgggtttgatattaatgagtttctgagttgttcatcaagttccaagaaaagcatgtcttgttctctgactggcagcctggcccttcagcctgaccagcagcaggaccacgagaccacggactcctctcctgcctctgcctatcagagagtctgggaagcatttgccaatcagtccagagcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacgtcgccctgctttgcggcctccgggctcaggtgtacaagttctccatctcctggtcccggatcttccccatggggcacgggagcagccccagcctcccaggcgttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgaccttccatgagccgtgggtgatgagctacgcaggctatggcaccggccagcaccctcccggcatctctgacccaggagtggcctcttttaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaaggctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacaccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggtgtgtcccactaccgtttttccatctcctggtctcgcatcctccctgatggaaccaccaggtacatcaatgaagcgggcctgaactactacgtgaggctcatcgatacactgctggccgccagcatccagccccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgttgaatgagccctttgtcattgcttaccagggctatggctacggaacagcagctccaggagtctccaataggcctggcactgccccctacattgttggccacaatctaataaaggctcatgctgaggcctggcatctgtacaacgatgtgtaccgcgccagtcaaggtggcgtgatttccatcaccatcagcagtgactgggctgaacccagagatccctctaaccaggaggatgtggaggcagccaggagatatgttcagttcatgggaggctggtttgcacatcctattttcaagaatggagattacaatgaggtgatgaagacgcggatccgtgacaggagcttggctgcaggcctcaacaagtctcggctgccagaatttacagagagtgagaagaggaggatcaacggcacctatgacttttttgggttcaatcactacaccactgtcctcgcctacaacctcaactatgccactgccatctcttcttttgatgcagacagaggagttgcttccatcgcagatcgctcgtggccagactctggctccttctggctgaagatgacgccttttggcttcaggaggatcctgaactggttaaaggaggaatacaatgaccctccaatttatgtcacagagaatggagtgtcccagcgggaagaaacagacctcaatgacactgcaaggatctactaccttcggacttacatcaatgaggccctcaaagctgtgcaggacaaggtggaccttcgaggatacacagtttggagtgcgatggacaattttgagtgggccacaggcttttcagagagatttggtctgcattttgtgaactacagtgacccttctctgccaaggatccccaaagcatcagcgaagttctacgcctctgtggtccgatgcaatggcttccctgaccccgctacagggcctcacgcttgtctccaccagccagatgctggacccaccatcagccccgtgagacaggaggaggtgcagttcctggggctaatgctcggcaccacagaagcacagacagctttgtacgttctcttttctcttgtgcttcttggagtctgtggcttggcatttctgtcatacaagtactgcaagcgctctaagcaagggaaaacacaacgaagccaacaggaattgagcccggtgtcttcattctgatgagttaccacctcaagttctatgaagcaggcctagtttcttcatctatctttaccggccaccaaacaccttagggtcttagactctgctgatactggacttctccataaagtcctgctgcaccgttagagatgactttaatcttgaatgatttcgacttgctgagtaaaatggaaatatctccatcttgctccagtatcagagttcatttgggcatttgagaagcaagtagctcttgcggaaacgtgtagatactggtctagtgggtctgtgaaccacttaattgaacttaacagggctgttttaagtttcagagttgttaagggttgttaagggagcaaaaaccgtaaaaatccttcctataagaagaaatcaactccattgcatagactgcaatatcatctcctgcccttctgcaagctctccctagcttcacatcttgtgttttccagaaaataaaaacagcagactgtcaaaaaaac

SEQ ID NO: 415469 - DNA, 462 bp, Homo sapiens
tgcgtaatttatagagaaaaaaggtttatttagctcatggttctggggactgggaagttcaagatcaggcagccacatctggtcagcttctggtgagggcctcatgctgcatcctaacctggcagagaagtggaaggggaaggaagtgcctgcaaacagataaaacaccagaagcagcctcactttataacaaccactgtatggtaactaatccagtcccactagaatgggaactcactcactccctggagactgcactaatccctgaaggcggatccctcatgacccaaatgcctcttaaaagtccataacctctcaataatgttacactggcaattaaatttcaacatgagtttttgtagggacaaaccacatccaaaccatagcacacctggaccccatcccagcaatgggttggctccacagggcccctgaagtttatccatagataccatttaataa

SEQ ID NO: 415470 - DNA, 919 bp, Homo sapiens
ctcactccctggagactgcactaatccctgaaggcggatccctcatgacccaaatgcctcttaaaagtccataacctctcaataatgttacactggcaattaaatttcaacatgagtttttgtagggacaaaccacatccaaaccatagcacacctggaccccatcccagcaatgggttggctccacagggcccctgaagtttatccatagataccatttaataatgcttatctgaactcacctttgatggcataacaatttctgttcttagatcccacctctctctaagtggttaaaattgtaccttttctgtttatgcgtattttaccacaattttaaaaatattccacccctttctgatctttgagttcttctaaatcaattgttcccaaagttgtggtccccagaccagcagcatcaacattagcatcacctgggagctcattagaaatgcatattcttgagccctacttgagacctactgcatcagacactcttggggtgggaccagcaacctgtgttttaacaagctctacagatgattttgattcaccttgaagtttgagaaccacttttaagtaataagtaagtagaattcacttctaagcttttaaagtcgttagcccatggtattttccaaaggggcttggaaccactgcttggagtttgggtgtgtcgtatgagcgaggaaaactgttgatttcagacttgcatgttcttagttggcatttacatagagttaattcaatttcttctcttacagccataaataaagaccaagtgctcaccattgggtttgatattaatgagtttctgagttgttcatcaagttccaagaaaaggtaatgtcaggttgcctattgaactatcaataactgatatttgtagaatactctgtttcttttacatgtataatct

SEQ ID NO: 415471 - DNA, 5513 bp, Homo sapiens
gttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggaagcacccagaatccagacgagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtcacaactccagaccctcagtgatgcccacagaaaagcctatgagatttaccacgaaagctatgcttttcagggcggaaaactctctgttgtcctgcgagctgaagatatcccggagctcctgctagaaccacccatatctgcgcttgcccaggacacggtcgatttcctctctcttgatttgtcttatgaatgccaaaatgaggcaagtctgcggcagaagctgagtaaattgcagaccattgagccaaaagtgaaagttttcatcttcaacctaaaactcccagactgcccctccaccatgaagaacccagccagtctgctcttcagcctttttgaagccataaataaagaccaagtgctcaccattgggtttgatattaatgagtttctgagttgttcatcaagttccaagaaaagcatgtcttgttctctgactggcagcctggcccttcagcctgaccagcagcaggaccacgagaccacggactcctctcctgcctctgcctatcagagagtctgggaagcatttgccaatcagtccagagcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacgtcgccctgctttgcggcctccgggctcaggtgtacaagttctccatctcctggtcccggatcttccccatggggcacgggagcagccccagcctcccaggcgttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgaccttccatgagccgtgggtgatgagctacgcaggctatggcaccggccagcaccctcccggcatctctgacccaggagtggcctcttttaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaaggctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacaccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggtgtgtcccactaccgtttttccatctcctggtctcgcatcctccctgatggaaccaccaggtacatcaatgaagcgggcctgaactactacgtgaggctcatcgatacactgctggccgccagcatccagccccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgttgaatgagccctttgtcattgcttaccagggctatggctacggaacagcagctccaggagtctccaataggcctggcactgccccctacattgttggccacaatctaataaaggctcatgctgaggcctggcatctgtacaacgatgtgtaccgcgccagtcaaggtggcgtgatttccatcaccatcagcagtgactgggctgaacccagagatccctctaaccaggaggatgtggaggcagccaggagatatgttcagttcatgggaggctggtttgcacatcctattttcaagaatggagattacaatgaggtgatgaagacgcggatccgtgacaggagcttggctgcaggcctcaacaagtctcggctgccagaatttacagagagtgagaagaggaggatcaacggcacctatgacttttttgggttcaatcactacaccactgtcctcgcctacaacctcaactatgccactgccatctcttcttttgatgcagacaggtaagtccaccaacagggagcccggagccatctctggaaaaggcagaaaggtgcccttggctgtgctctctgaggcctgcccagcctcaaaacagggcctccaacgccgaatgtgccggggtttgcaagatgctcgccaccccacagatcccaaggaaatctccagcaagcaagagggagagaaggccggggtctccagggcacctcccattagggcacatgtgcttggctttttgtttttttatttcatttttaaaatttatttattttgcgttctttttcacaggctgcttaactctaaaaatgcttggttgttaaaaaggattttcaagaaaaaaattgtttaggttttatcaaaattcgctttaatattaataaatattacaataat

SEQ ID NO: 415472 - DNA, 2212 bp, Homo sapiens
ggcacgaggtgagaagctgcagcgagcccaggctgaactggagaatgtgtctggggcgctgaacgaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgga

SEQ ID NO: 415473 - DNA, 1397 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgga

SEQ ID NO: 415474 - DNA, 3042 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgga

SEQ ID NO: 415475 - DNA, 2981 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgga

SEQ ID NO: 415476 - DNA, 3167 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggaaaaaaaaaaaaaaaaaaactcgaggggggcccgtccccaattcgcctataggagtgtattacaattactggccgcggttacaacgtctgactggaaaaccttgcgtacccaactaatggctggag

SEQ ID NO: 415477 - DNA, 1651 bp, Homo sapiens
ttgacatgatagaattgagctggtaccggtgtttataaggtgtgtgctgggatggagcttggactgtgtgcgttgtgttaaacgtggatggatggggatgagatggagatgaggtggcaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgga

SEQ ID NO: 415478 - DNA, 2947 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctcccttctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgga

SEQ ID NO: 415479 - DNA, 2837 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatttatacacctcacctcgatacatccaaccatcccatcacaccataaaccctaaacacacaacacaccaccaagcaaac

SEQ ID NO: 415480 - DNA, 2869 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgttatcacccccacctgggtcccctgcaacctcccatcaaaggatgacccctaaacacagaggagcggggcaggcagggaggcaatgactggagctaccttgcttgttccgctg

SEQ ID NO: 415481 - DNA, 2697 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaactgaaggctcagatgcctctgccggccagggcaaggaggaggcggtgaaacacgtcgcaagatgcaggcccagatgaaggagctatggcgtgaggtggaggagacacgcacctcccgggaggagatcttctcccagaatcggga

SEQ ID NO: 415482 - DNA, 573 bp, Homo sapiens
gggtgagtctagaggatcccgtgtgtggcaggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgga

SEQ ID NO: 415483 - DNA, 2395 bp, Homo sapiens
caccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatcccctctcactcctgctgctgcccatgctctgccctcccttctggttgctctgagggttcggagcttccctctgggactaaaggagtgtcctttaccctcccagcctccaggctctggcagaaataaactccaacccgactgga

SEQ ID NO: 415484 - DNA, 133 bp, Homo sapiens
cattcctgccagtgtggtagagagttgaggcagatggggtcactgggtggaagccacgattggagggcttcattcccgtcccttccctgcaggctgaactggagaatgtgtctggggcgctgaacgaggctga

SEQ ID NO: 415485 - DNA, 342 bp, Homo sapiens
agaggttgcagtgagccgagattgtaacactgcactccagcctgagtgacagagtgagaataaacaaacaaacaaacaaactgagaaggggaacccaaagctaaaggtcaaagacagtggcaaggggtctgactccagaaacccggagtcagagctgctctgtcagacgtgctcaggaacccaggtaagggcgtcttggaaacggcaccttccagagcaagccagcgaccacgctaaggtcagctggtccgtgttccatccctgaaatgttctgggtcacacgacagggtcatgtggattgttctgctaggtggttttgtgggtcccctgtatttaacacca

SEQ ID NO: 415486 - DNA, 283 bp, Homo sapiens
agaggttgcagtgagccgagattgtaacactgcactccagcctgagtgacagagtgagaataaacaaacaaacaaacaaactgagaaggggaacccaaagctaaaggtcaaagacagtggcaaggggtctgactccagaaacccggagtcagagctgctctgtcagacgtgctcaggaacccaggtaagggcgtcttggaaacggcaccttccagagcaagccagcgaccacgctaaggtcagctggtccgtgttcggggggagggggggggggggggaattc

SEQ ID NO: 415487 - DNA, 6244 bp, Homo sapiens
  misc_feature (2033)..(2033): n is a, c, g, or t
  misc_feature (4968)..(4968): n is a, c, g, or t
  misc_feature (5127)..(5127): n is a, c, g, or t
tgaggggattcctgcatgtcagaccctggctattatcctggagtgtgcgcctggaggcctaggtggggttaccaagtgcagggacagctaggctgtcccctctgggatggaacaaccaacccccccggagactgtgcctgcaggtgtccatcaccttcaaggacttggccgtgcggttctcggaggaggagtggcggctcctggaggaggggcagagggagttctaccgagacgtgatgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgaggctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcaaaactgccgacaaaccgtggcctacaaggaaggaaggcccaggagccctgggcggggagcccagccctcccacccatagccccagcaggaggaagagccacagaggacaggagagagggacctcagaggccggaatttctcctgggaacagccccttgcaaggcctcatcaactgtctgaaggaaatccttgtgcctgggccccggcaccccgagacatccccaagcttcttgccacctctccctagcctgggcacgtccaggctaaccagagcagacctggggcctgggagcccgccctgggcagtgaagaccgaggcggtttcaggggattgtcccctccagggtctgctacactgtctgaaggagctccccgaggcccaggacaggcatcccagtccctcaggagtggggaaccgacggctacaggagaatccaggagcctggaaaaggggttctggagggcctggatacctcctgacccctcctccccatcctgatcttggagctggcggtctgctctctgtgaagatggagaacagctgggtccagagccccccaggacctgcatcctgtcagcctggcaggcagcccctcagtccctcagccactggagacaccagaggggtcccccaacccagctggggccctgaggctcaagctgccagtgcctcaagctcaccgctggaagccctggaagcctgtctgaagggcattcccccaaatgggtcgtcaccttcccagctgccacccacttcttgttcccagaacccccagccaggagactctaggtctcagaagcctgaactgcaaccccacagatcacacagtgaagaagcgaccagagagcctgttctgcctctgggtctgcagagctgtgtgagagatggccccagcaggcccctggccgcgcgaggaagccccacgagcttctcctcatccagcagcaccgactgggacctggattttgggagtcctgtggggaaccaggggcagcatcctggaaaaggaagcccaccaggaagctccccactgcagggtctggagaattgtctcaaggagatacctgtgcctgtgctgcggcctgcctggccctgctcctcagcagcagacaggggaccgaggagagcagagcccaggaactggacagcagacaaggaagggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctganctctggaagccgctcccccaggagagggaccgccttcccagctgtaagcctcctgtccctctgtccccatgtcctggtgggacccctgctggcagcagtggcggcagccctggtgaagaccccaggagaacagagcccaggtacagctcaggatccctgcccggtttctcagctggagaaaaggcccagggttagtgaagcatccagaggcctggagcttggacatggaagacccagagttgcagccaagacccatgagaggctgctcccccagggcccgcctgagctgcccagtgagtctccccctccggagctgccccctccggaagctgcgcctcctgtgttgccagcctcctccctgcagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtctaagctggacttacctctgtggattctgaaattaaagaagtgagttgctaaggaaggccctgactcctatagaagggaggtccatgtgggcccacgctggggcggggctggttgtgccaccagcacgctgcctcgtctcccagacatcctcgagaacattcaggagtgtgccaggaagggtggggcaattcccacaggactcctggggcacactctgagtcccctggggctgcctcacagaggaaccctgcctgggcagcttcaacagcagcacatattgtctctgtcctggaggccagaagtctacaatccaggtgtcaggttcagttcctgctttgggctgggagggaggatcggtcccggacctctccccttgacctgtagatggctgtcttcctgttcagatggtgttttctacacagctgtctccagatttccccttcatatcagggcagcagttgtatggggttatgacccaccctaatgacttcattttaacctgattacctctctaaacaccccctctccaagtgaggtcacatttggaggtactggaggttaggccttcaccatacacatttggggaggggcacagttcagcctgtaacacaccaaacgggctgggccagtcttcctggttttgtcttgggaaaagacatgaccaggtatcactagcccacttctgtcctggttaccggaatgtgcctgctcccagcccgctcagctggcgcttggcaatgcgttggaaccagcctgcctgtcattcccttgcatcatcttcccaagaggcagaatgcaacctgtgtgcccccaaatcccttatttgacctgaggtggtttcaggacctgtatgtgcacctgttgactggcagggccagcctggtgtggactggcagggccagcctggtgtggactggcacacttggccctgtcctcaggtccctgaggagcctgggacaccagcactgtggcctggggcaatgctggctgcccaccatgactacaggagcagtgccttgtggctgcagcgcccagtgtgtccctcaagtcagggtcactggggacacactcggggcctaagtgccctgcagctgagcttgggagctgaagcccttgctctttgccaccctgtagaagcagcagggcaaggacacctgtcagaggggaatgcccgcaacagactgaacatcacaaagggatgggaagatgctttcaggactagagtgagccccgaggtgactgtctggaaacagatcctaagaccatacaagtaggatgtttgttgaaatacggaggctgttcgctcacagccgtgcttgcacagaatcaggaagggaaagtttctaggttgctcctgcctgaggagctctccttntaataagcagggagcagtgccgggcacgtttcagagccacggcaaggggtgggacacagtttcagaggggggttgagaagcgaaactgcccctgccctgactctggctgtgaggagaggactcttgcccacccctgctgcagctggtgcagtcccatcntgcctgcctgtcctcccattctcctttcccttctaagcaggggtcactgggctgtcgactcaatgggagggggggtcaccttacacttctgtgtggcacattaaggtggttttgctttgctggcttccgaaacagccaccacgcaaaccctagttgacaggcacgactgaacaaatgagcatggtggctgtaagtgactgtcacagttaggcagccttcaaccagcagagctaggaagagagctcgagccctcaccagtgccgccagcactcggcgcatcctcaccctgggcacagatgccccctcccagcctttgcctgctgggacagaccagggtattcaggactgagcctggtctaggtggtccagacccagttggaccatataataagtttaaagttgttttaagaatgtggattctaagtaataagtggtaagaagttccatggtctgcagctgcgttcctcctgcagaagcagttccctaggtctaggtctccaggacctgtccacagtcactgaaacgccttctagaattgatctagtggaaaatctagatgcagtttaggtctttggcactgtgcccatctcctttaagaactgtgcagtgtggcttggaagaggaaatgtggtccctttgatgggagaaactgaaggacctttttgaactcaaaggagctccagggtttggaattgggggcagagaaggctccaggctgctcattccatcctgggtgagccgaacgggtcctggctgatctgagtgcgaccttcccagtctgccagccagagtcccccagcaggcaggaacatgtgaaggttccgcttcaaaatatgaatgaatgggctcctcgtgcccctattattttctggccacccccaggggtcctgatggaagggaggctggcctgcggggtgcaagaaccacgattcactgctccccgctgaaggtgcttggtcaagagcagcaggcatgctgttaacctttgtgcgggtttgtgttttggatgtggctcctatgcacaacctatggattttatctcataaaccatcttgacagattttgctcgtcaactgggagcccttaatccatttaaatgtaattgactgactgattt

SEQ ID NO: 415488 - DNA, 7153 bp, Homo sapiens
  misc_feature (2919)..(2919): n is a, c, g, or t
  misc_feature (5877)..(5877): n is a, c, g, or t
  misc_feature (6036)..(6036): n is a, c, g, or t
tgaggggattcctgcatgtcagaccctggctattatcctggagtgtgcgcctggaggcctaggtggggttaccaagtgcagggacagctaggctgtcccctctgggatggaacaaccaacccccccggagactgtgcctgcaggtgtccatcaccttcaaggacttggccgtgcggttctcggaggaggagtggcggctcctggaggaggggcagagggagttctaccgagacgtgatgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgaggctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcagtgagtctgacacagcagggacagggagaaccagcatttcaaaagccctgatcgtggcgtcagaggacctggaccctgtgccctcttcatttttttctaggactcagttcccctgttgtgctgttcttttgttaacaaagtacgccagggagcaggacaacatatttagcctctggtgtaaccaccaaagaggaggcatgatgctcagcccctggggagcctgtcatcccgccccgatcactgagcactttgtacacagaaagtctccggcagtttctaacatgcaggcccacggccagcagcattgacctacctgtgtgcactggtctgatccttagaccgtctcatcacagcaaccctaactgcagagcagggcaaggggagctcctaggatttctctggggtctcattttatttttaaaacttctcacaaattttgcatgtctgtttttataaaaaagtacttcaaatttatatggaataaaattggcactcccaaagagcataccccatttagctgtggtttcatctggtgttcaggggtcgtcgggcacacttgctctggggttctgtgtgccctgtgtgtgccctggtttgagaagcgtgagtgtgagattgtggcctacatgtcaaggctgccggcatcacttcctgagccaaattccgaggctgggctcagggggaagggtctgggagtgttcacagtgaaccaacagtcttgctgtttccagttaaaccagaaagaaacggtaaaggccctcagcccacctcgaacagggacttgggtggctggagagggctgtcctctatgggaaccagatctggtgtgattttccagagtctggagctggggctagaaaggccctcttgtcttctcctgcaacagaaactgccgacaaaccgtggcctacaaggaaggaaggcccaggagccctgggcggggagcccagccctcccacccatagccccagcaggaggaagagccacagaggacaggagagagggacctcagaggccggaatttctcctgggaacagccccttgcaaggcctcatcaactgtctgaaggaaatccttgtgcctgggccccggcaccccgagacatccccaagcttcttgccacctctccctagcctgggcacgtccaggctaaccagagcagacctggggcctgggagcccgccctgggcagtgaagaccgaggcggtttcaggggattgtcccctccagggtctgctacactgtctgaaggagctccccgaggcccaggacaggcatcccagtccctcaggagtggggaaccgacggctacaggagaatccaggagcctggaaaaggggttctggagggcctggatacctcctgacccctcctccccatcctgatcttggagctggcggtctgctctctgtgaagatggagaacagctgggtccagagccccccaggacctgcatcctgtcagcctggcaggcagcccctcagtccctcagccactggagacaccagaggggtcccccaacccagctggggccctgaggctcaagctgccagtgcctcaagctcaccgctggaagccctggaagcctgtctgaagggcattcccccaaatgggtcgtcaccttcccagctgccacccacttcttgttcccagaacccccagccaggagactctaggtctcagaagcctgaactgcaaccccacagatcacacagtgaagaagcgaccagagagcctgttctgcctctgggtctgcagagctgtgtgagagatggccccagcaggcccctggccgcgcgaggaagccccacgagcttctcctcatccagcagcaccgactgggacctggattttgggagtcctgtggggaaccaggggcagcatcctggaaaaggaagcccaccaggaagctccccactgcagggtctggagaattgtctcaaggagatacctgtgcctgtgctgcggcctgcctggccctgctcctcagcagcagacaggggaccgaggagagcagagcccaggaactggacagcagacaaggaagggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctganctctggaagccgctcccccaggagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtacagctcaggatccctgcccggtttctcagctggagaaaaggcccagggttagtgaagcatccagaggcctggagcttggacatggaagacccagagttgcagccaagacccatgagaggctgctcccccagggcccgcctgagctgcccagtgagtctccccctccggagctgccccctccggaagctgcgcctcctgtgttgccagcctcctccctgcagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtctaagctggacttacctctgtggattctgaaattaaagaagtgagttgctaaggaaggccctgactcctatagaagggaggtccatgtgggcccacgctggggcggggctggttgtgccaccagcacgctgcctcgtctcccagacatcctcgagaacattcaggagtgtgccaggaagggtggggcaattcccacaggactcctggggcacactctgagtcccctggggctgcctcacagaggaaccctgcctgggcagcttcaacagcagcacatattgtctctgtcctggaggccagaagtctacaatccaggtgtcaggttcagttcctgctttgggctgggagggaggatcggtcccggacctctccccttgacctgtagatggctgtcttcctgttcagatggtgttttctacacagctgtctccagatttccccttcatatcagggcagcagttgtatggggttatgacccaccctaatgacttcattttaacctgattacctctctaaacaccccctctccaagtgaggtcacatttggaggtactggaggttaggccttcaccatacacatttggggaggggcacagttcagcctgtaacacaccaaacgggctgggccagtcttcctggttttgtcttgggaaaagacatgaccaggtatcactagcccacttctgtcctggttaccggaatgtgcctgctcccagcccgctcagctggcgcttggcaatgcgttggaaccagcctgcctgtcattcccttgcatcatcttcccaagaggcagaatgcaacctgtgtgcccccaaatcccttatttgacctgaggtggtttcaggacctgtatgtgcacctgttgactggcagggccagcctggtgtggactggcagggccagcctggtgtggactggcacacttggccctgtcctcaggtccctgaggagcctgggacaccagcactgtggcctggggcaatgctggctgcccaccatgactacaggagcagtgccttgtggctgcagcgcccagtgtgtccctcaagtcagggtcactggggacacactcggggcctaagtgccctgcagctgagcttgggagctgaagcccttgctctttgccaccctgtagaagcagcagggcaaggacacctgtcagaggggaatgcccgcaacagactgaacatcacaaagggatgggaagatgctttcaggactagagtgagccccgaggtgactgtctggaaacagatcctaagaccatacaagtaggatgtttgttgaaatacggaggctgttcgctcacagccgtgcttgcacagaatcaggaagggaaagtttctaggttgctcctgcctgaggagctctccttntaataagcagggagcagtgccgggcacgtttcagagccacggcaaggggtgggacacagtttcagaggggggttgagaagcgaaactgcccctgccctgactctggctgtgaggagaggactcttgcccacccctgctgcagctggtgcagtcccatcntgcctgcctgtcctcccattctcctttcccttctaagcaggggtcactgggctgtcgactcaatgggagggggggtcaccttacacttctgtgtggcacattaaggtggttttgctttgctggcttccgaaacagccaccacgcaaaccctagttgacaggcacgactgaacaaatgagcatggtggctgtaagtgactgtcacagttaggcagccttcaaccagcagagctaggaagagagctcgagccctcaccagtgccgccagcactcggcgcatcctcaccctgggcacagatgccccctcccagcctttgcctgctgggacagaccagggtattcaggactgagcctggtctaggtggtccagacccagttggaccatataataagtttaaagttgttttaagaatgtggattctaagtaataagtggtaagaagttccatggtctgcagctgcgttcctcctgcagaagcagttccctaggtctaggtctccaggacctgtccacagtcactgaaacgccttctagaattgatctagtggaaaatctagatgcagtttaggtctttggcactgtgcccatctcctttaagaactgtgcagtgtggcttggaagaggaaatgtggtccctttgatgggagaaactgaaggacctttttgaactcaaaggagctccagggtttggaattgggggcagagaaggctccaggctgctcattccatcctgggtgagccgaacgggtcctggctgatctgagtgcgaccttcccagtctgccagccagagtcccccagcaggcaggaacatgtgaaggttccgcttcaaaatatgaatgaatgggctcctcgtgcccctattattttctggccacccccaggggtcctgatggaagggaggctggcctgcggggtgcaagaaccacgattcactgctccccgctgaaggtgcttggtcaagagcagcaggcatgctgttaacctttgtgcgggtttgtgttttggatgtggctcctatgcacaacctatggattttatctcataaaccatcttgacagattttgctcgtcaactgggagcccttaatccatttaaatgtaattgactgactgattt

SEQ ID NO: 415489 - DNA, 1000 bp, Homo sapiens
tcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415490 - DNA, 1353 bp, Homo sapiens
tagtgcctataaaccgttgttaaaaagcaggctgtacggtccggaatcccggcacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415491 - DNA, 3983 bp, Homo sapiens
  misc_feature (1432)..(1432): n is a, c, g, or t
  misc_feature (1464)..(1464): n is a, c, g, or t
tcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcaactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgnggcccctcgcagggtggcgagtggggtccgtncctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcatgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctgcacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415492 - DNA, 3283 bp, Homo sapiens
  misc_feature (732)..(732): n is a, c, g, or t
  misc_feature (764)..(764): n is a, c, g, or t
aactgttgacccctctagagaggacaccccaagtccatcctgggctcctcctcacccctctgagaaagcccccctaaaaaaaggcttcagagtcaccggcatgccgcctcacgttgcaggacggaatcgcgcgctcctcacgctggagtaagttacgaaacatgatcgtcaggctctttgcaaacgcagagccccagaacgctggatggaggcctcctcggccctgcgggcggcctggctgcggtaggtctgctgcaaggagccaccacggggactgcgccacactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgnggcccctcgcagggtggcgagtggggtccgtncctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcatgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctgcacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415493 - DNA, 4021 bp, Homo sapiens
  misc_feature (1432)..(1432): n is a, c, g, or t
  misc_feature (1464)..(1464): n is a, c, g, or t
tcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcaactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgnggcccctcgcagggtggcgagtggggtccgtncctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcatgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctcgcgcctggcctctgtcactttttttgctccttacccagcacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415494 - DNA, 2636 bp, Homo sapiens
tttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccactgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctcgcgcctggcctctgtcactttttttgctccttacccagcacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415495 - DNA, 2982 bp, Homo sapiens
  misc_feature (1432)..(1432): n is a, c, g, or t
  misc_feature (1464)..(1464): n is a, c, g, or t
tcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcaactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgnggcccctcgcagggtggcgagtggggtccgtncctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcagcacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415496 - DNA, 2129 bp, Homo sapiens
atggtgtaaagacggagagtataccctgtcatcggggttcgtaggcaggatgggtgattagtgctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctcgcgcctggcctctgtcactttttttgctccttacccagcacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415497 - DNA, 2002 bp, Homo sapiens
ctacaatggaaagactcctagttggttattctttatctcggattcttttttctggaattgtttgctcatttgagtggttggtggtttgccctgtgtcagacacggtgaaaagagtgcaggaaagctggggccaggggaagcgaagtggcttcaatccgggctgacagccaagaagagttttcctcccttcggtgacagggcctgcccctccgagtctagaggtaaaagcagcttctagaactggcccctaagtctccaaatgtgttggctaagctgaaatgagagactctgaattagagtttttgtttgttgtttgttctctgcatgaagttcacaggcctgtatggatgttaaattgtgtctatagcctctaaatctccaggttaactggtccagattttttttttttaatcagtaacaatgggaatttaaaatcaaatatttggccaggtgcggtggctcatgcccgtaatcccagcactttgggaggccgaggcaggcgcatcaccctgaggagttggagaccagcctgaccaacatggtgaaatcctgtctctactaaaaatacaaaaaattagccaggcgtggtggcgtgtgcctgtaatcccagctaccagggaggctgaggcatgagaatcgcttgaacctgggagatggaggttgcagtgagccgagatcatgccactgcactccagcctgggcacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgaccctgcggctccggtgtggtccttctgcgcaggtggctactgaaggtggcggacggacagacggcctggacacacagacaccaggcccctggacacataggctcccgaccccctggatacacaaacacctgaccccctggacacacaggctcctgacccccggacacacagacccctgagcccctagacatacaggcacctggccccctggacacagaggctcccgaccccctagacatacaggctcccggccccctggacacacaggcccctgaccccctggacacacaggcccctgaccccctggacacacagacccctgacccctggacacacagacccctgagcccctggacatacaggctcccgg

SEQ ID NO: 415498 - DNA, 1498 bp, Homo sapiens
tcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcactgcttcattgccaagggcgtggaaagggggtggtggatggagccgggaggtggcgagcacaggaccccggggctgcattctgccgtgtggggttctgcactgtctagcttctgcggggactgcaaagagggatgaagggacgtggtcctaggggtcggctcagactcggagcagggcagggagaggagggcaaggagaggaggcctgggtcctggatccactgctctgggctcataaccatgagattttgaaagagtttttggtcatctgagcaggtaccatgcctggctcatgccggaacttgtcttggaaccggtagccagaggcccaggaagggacagggcccaaaagggttgcatgtcccggccacaaagccctccctgtgtgccctgagccagcccagcaagcgcctcccagccaggcgctttcgcagaagcaagagcacaggccagggggaccgggagagcctcagcccccagcctgggcggcctgtgaccctgagccgtgtggagcc

SEQ ID NO: 415499 - DNA, 284 bp, Homo sapiens
gcggccgcctactactactgctcgaattcaagcttctaacgatgtacggggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtacatg

SEQ ID NO: 415500 - DNA, 1409 bp, Homo sapiens
gctgcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactgaatcctggaacctgctccttctgctctcgtgactgactgtgttctctatgcaacttccaataaaacctcttcatttgaaaggaaaaaagtctgcattatctgtttaggaagggagagagttcatattgcaatctttttttttttaataaaaataatctcagcctgggcaacatggtgagaccccatctctgtaaaacatttttaaaaaattagccgggtatggtggcgcacacttgtagtcccagctactcaggaggctgaagcgggaggatccattgaacctgagaagtcgaagctgcagtgagctgtgattgtgccactgtactccagcctggacaacagagtgagacgccgtctcaaataaataaatacat

SEQ ID NO: 415501 - DNA, 650 bp, Homo sapiens
cagaggcttctgtaacctgcctgctcccagcattctatttagggtctggtatgtccagaatttgcagacacagcaattcctgcagcagcagtgcaccatgtggaaggggccccatgaccagcccactgtgagctcacacgtgatgactgaggcttcttcacacagcagggctctgggtgtgatacccagggcacacgcgtttgcacaggcacaggccacacaagttctcacatgctcagccccataagccgtgctggacaggcatggccatttacacccaggatcctgctgagaacagcaaccaactcaccaccctcgcatcatgatccttgccacacaggggctctggtggctttggtggcctgggctgtggctctgctgccagccaccttgagtgaagatccgggttctctgggtgctactcagctgctatgtggggagctggcccctggggtgatgagggcccttcccaacccgccctcagcccttggacagccaggatcacccggggctgtctgcatacagacttctcaggggagttctcagcttggacccttatctccccagaatcctggaacctgctccttctgctctcgtgactgactgtgttctctatgcaacttccaataaaacctcttcatttgaaagga

SEQ ID NO: 415502 - DNA, 941 bp, Homo sapiens
cagaggcttctgtaacctgcctgctcccagcattctatttagggtctggtatgtccagaatttgcagacacagcaattcctgcagcagcagtgcaccatgtggaaggggccccatgaccagcccactgtgagctcacacgtgatgactgaggcttcttcacacagcagggctctgggtgtgatacccagggcacacgcgtttgcacaggcacaggccacacaagttctcacatgctcagccccataagccgtgctggacaggcatggccatttacacccaggatcctgctgagaacagcaaccaactcaccaccctcgcatcatgatccttgccacacaggggctctggtggctttggtggcctgggctgtggctctgctgccagccaccttgagtgaagatccgggttctctgggtgctactcagctgctatgtggggagctggcccctggggtgatgagggcccttcccaacccgccctcagcccttggacagccaggatcacccggggctgtctgcatacagacttctcaggggagttctcagcttggacccttatctccccagaatcctggaacctgctccttctgctctcgtgactgactgtgttctctatgcaacttccaataaaacctcttcatttgaaaggaaaaaagtctgcattatctgtttaggaagggagagagttcatattgcaatctttttttttttaataaaaataatctcagcctgggcaacatggtgagaccccatctctgtaaaacatttttaaaaaattagccgggtatggtggcgcacacttgtagtcccagctactcaggaggctgaagcgggaggatccattgaacctgagaagtcgaagctgcagtgagctgtgattgtgccactgtactccagcctggacaacagagtgagacgccgtctcaaataaataaatacat

SEQ ID NO: 415503 - DNA, 3234 bp, Homo sapiens
gctgcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcagtgttgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgggcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtacatg

SEQ ID NO: 415504 - DNA, 1257 bp, Homo sapiens
caggtcctgatgaagaccctggggaccctcagggttgagtggggtggggctcctgagggtccccagggtcctgatgaagacctccgaccccagcgccaggctcctcggagcccaacagtcccaagggggcagtgttgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgggcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtacatg

SEQ ID NO: 415505 - DNA, 766 bp, Homo sapiens
ctgcttgtcctgcctctgctgtagagatttgtggaattttgaacttgagagatttagggtatctgatagggtacttgaacttgagatttagggtatctgatagaagaaatttctaagcagcaaagcattcaagagatgacttgggtgctgttaaaggccttcagttttataagggaagcagagcatgaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtacatg

SEQ ID NO: 415506 - DNA, 820 bp, Homo sapiens
gtccaggtctgctccattttccaggctctttccttagtctcaggacgctcctcacccgggaggggaagcagcctgggaaaatgagaagccttgcccacgaatctccagcgcaaaaggcagcagctttttcctccccagctcctttctgcgtcggcggcgaagagagagctctgctccctgcttttttagaaaatggatttgacgtggccgaacctgcggctagccgtgcgacccgcacaagggagggactgttctcagtaggaggctggactcagagcggcgcggcgcccggggctgtttcgtgagctggagccagcggctgcccgggcggcggtgcgcgcactctccaggctgagacacgactggctggcacgagttgctcggcaccagctgagctgtcaaccgcgagcggaggcggggctcccgacaaccagtgtgctggggcagaatcggcccaggttacacgccccctgaaccaccctcgcgtctccccgacccctctctcgctggctcagatgaatgatgacggcagagggcagagagcttagaggacgcggtaccaagccccgtccctcgcccatcccaacgaaggtcttagaatacaatcaaccaactacaggaagaatttgtagaggaggttttcttgtgtgtctgcatcgccccacccacagccatgtgaggacacagcatctgtggcaacaaggagccatcttgggagcagagagcaagctcttccagacactgaatctgccagcaccttgatcttggtccagccttcagaactgtgagaaataaatttctattatttacaaattaacca

SEQ ID NO: 415507 - DNA, 392 bp, Homo sapiens
cctcctctcacccaggatcacttccgaaaccacttggccttcagcccctgcctcggccagaggtttcatttttaactgaatatttaccaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagccatgtgaggacacagcatctgtggcaacaaggagccatcttgggagcagagagcaagctcttccagacactgaatctgccagcaccttgatcttggtccagccttcagaactgtgagaaataaatttctattatttacaaattaacca

SEQ ID NO: 415508 - DNA, 443 bp, Homo sapiens
ggaagggctcatcagccttagcgccatttttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaaaataagaaaaaaaaag

SEQ ID NO: 415509 - DNA, 464 bp, Homo sapiens
cggacgctgtgggcggacgcgtgggtcgacccacgcgtcgcggacgcgtgggttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaaaataagaaaaaaaaag

SEQ ID NO: 415510 - DNA, 499 bp, Homo sapiens
gcgccttttttttgggtgagtgttttttggttcctgcgttgggattccgtgtacaatccatagacatctgacctcggcacttagcatcatcacagcaaactaactgtagcctttctctctttccctgtattttggaaacctctgcgccatgagagccaagtggaggaagaagcgaatgcgcaggctgaagcgcaaaagaagaaatggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaaaataagaaaaaaaaag

SEQ ID NO: 415511 - DNA, 317 bp, Homo sapiens
ggaagggctcatcagccttagcgccatttttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtagctgaggttggaggattgcttgagcatgggaggcagaggttgcagtgtgccgagatcatgcctctgtactccagtctaggtgacagagtgtgaccctgtctcaaaaaa

SEQ ID NO: 415512 - DNA, 345 bp, Homo sapiens
ttaacccgtggaggaggaccaaggtttgtatctccccgtcacacccgaggccttggttcagagagggagcggagcagccattctccaggccccggggttgccccttggacgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaaaataagaaaaaaaaag

SEQ ID NO: 415513 - DNA, 541 bp, Homo sapiens
gcgccttttttttgggtgagtgttttttggttcctgcgttgggattccgtgtacaatccatagacatctgacctcggcacttagcatcatcacagcaaactaactgtagcctttctctctttccctgtattttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaaaataagaaaaaaaaag

SEQ ID NO: 415514 - DNA, 481 bp, Homo sapiens
gcgccttttttttgggtgagtgttttttggttcctgcgttgggattccgtgtacaatccatagacatctgacctcggcacttagcatcatcacagcaaactaactgtagcctttctctctttccctgtattttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccacaggagcagaaacatggaatgccagacgctggggatgctggtacaagttgtgggactgcatgctactgtctagcttaagcggatcagcgat

SEQ ID NO: 415515 - DNA, 2157 bp, Homo sapiens
gaaaccaccgttcctttttggcgtttcttcgtactcgaaacatggcaggttttaaaccagcagaatattccacagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatattgaacttcaccaacttaaaatctactgcagtgcaaacctcatagctcaagaaacatgttgtgaaatatcagatactaagtgcccagagcaggatggctttggaaatattgcatcatcatgggtaactgctcatgccagtaaaatgtcttcatatctgccagcaaagcaggaacttaaagaccagtgccagtgcattccaaacaagggagaagcaggattaccaggagctccgggttcacctgggcagaaagggcataaaggagagccgggtgaaaatggtttacatggtgctccaggattccctggtcaaaagggagagcaaggttttgaaggcagcaaaggagaaactggtgaaaagggtgaacaaggagaaaaaggagatccagctctggctggccttaatggagaaaatggtttgaaaggtgacttgggtcctcatggtccacctggcccaaaaggagaaaagggagatacaggacccccaggaccaccagccttacctggttccctggggatacaaggcccccaaggtccacctggaaaagagggtcagaggggaagacgagggaaaacaggacctcccggaaaaccaggacccccaggaccacctggacctcctggaatacaaggaatacaccaaactcttggtggatattataacaaggataacaagggaaatgatgaacatgaagctggaggcctgaaaggagacaagggtgaaactggactaccaggatttccagggtctgttggccctaaaggacaaaaaggagaacctggagagccttttacaaaaggagaaaaaggagatagaggagaacctggggtaataggatcacagggagtaaagggtgaacctggagatcccggaccccctggtttaataggaagcccaggactaaagggtcagcaaggatctgcaggctccatgggacccagaggaccgccaggagatgttggattgccaggagaacatggtatcccaggaaaacaaggcattaaaggagaaaagggagatccaggtgggatcataggccctcccgggcttccaggtccaaaaggtgaggctggtcctccagggaaaagcctgccaggggaaccaggattagatggaaatcctggagcacctggtccacgtgggccaaagggtgaaagaggacttccaggtgttcacggttccccaggggacataggcccacaagggataggaattcctggcagaacaggcgcccaaggaccagctggagagccaggtattcagggtcctcgaggtctccctgggttgccaggaactccagggactccagggaatgatggagttccagggagagatggaaagccaggcctgccaggccccccaggtgacccgattgcacttcctctcttgggagacatcggtgctttgctcaagaatttctgtggcaactgccaagccagtgtcccagggctgaaaagcaacaaaggagaagaaggaggtgctggtgagcctggaaagtatgattccatggcccggaagggtgatatagggccacggggtcctccaggaatcccaggaagagagggaccaaagggaagcaaaggagagcggggctaccctgggatacctggggagaaaggtgatgagggtcttcaaggaattccaggcattccaggtgctccaggcccgactggaccccctggcttaatgggaagaactggacatcctggtcccacaggagcaaaaggtgaaaagggcagcgacggaccccctgggaaacccggaccacctggaccacctgtgagttgttctaggcttaaaatttaa

SEQ ID NO: 415516 - DNA, 773 bp, Homo sapiens
actcgcagggagctcactcctcggcggtgccgcagccctgtccggactccactgcgcctctgaggggctcaaatacgaattcaagatccgtggccgttcacatggtttcaaggcacaatgagactcactggcccttggaaactttggctttggatgtcaatatttctgcttcctgcttccacttccgtgaccgttagggacaagacagtaaatctcgctgctgctcactctttgggtccacaccacctttaagagctgtaacacttgccgcgaaggtccacggcttcattcttgaagtcaacgagaccacaaacccaccagaaggaagaaaccctggacacatcggaaggaacaaactccagacacaccatctttaagagctgtaacactcactgtgaaggtctgcagcttcattcttgaagtcagcgagaccaagaacccactggaaggaaccaactccggacacagttttacataggatttatatgtcagtcactcccaaatgtacttcacagccctcacctctcttttgaattccattcctaactgtctatttgataactccattgtttcaatttcttaatggcatgtcagatttaacacttctaatttctcctctttcccactacagattaacttacgccttgccaagttttcttttatttttctagtgggatttatttcagtcaactaatctccctcctccctacattcaatcccttatcatctcctgttggttcttgtatctctcaattccttcccatgaaattgaa

SEQ ID NO: 415517 - DNA, 1069 bp, Homo sapiens
gaaaccaccgttcctttttggcgtttcttcgtactcgaaacatggcaggttttaaaccagcagaatattccacagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatattgaacttcaccaacttaaaatctactgcagtgcaaacctcatagctcaagaaacatgttgtgaaatatcagatactaagtgcccagagcaggatggctttggaaatattgcatcatcatgggtaactgctcatgccagtaaaatgtcttcatatctgccagcaaagcaggaacttaaagaccagtgccagtgcattccaaacaagggagaagcaggattaccaggagctccgggttcacctgggcagaaagggcataaaggagagccgggtgaaaatggtttacatggtgctccaggattccctggtcaaaagggagagcaaggttttgaaggcagcaaaggagaaactggtgaaaaggagctaccggcatgtgaacttctttcacaatcaatgtaaaagcaattcactgtataggaattgctgaacaagtgtgtcctaccagaccgaaatagcagaattccactgcacagaaaacagaggtgttagtgcagctgctgttccaagtggatgttgtacagtgactagctgttttgtaagttattgtctaggcttatggtggtctattgcttcttagtctaatatcttaaaaaaaatcattggtttttattttccttgatatccttgatatttccttacaatctcctttaagaacctccccatcaatgatctgttctaatatcagtaaaggatcaatgaaacaagacagaaatcaaat

SEQ ID NO: 415518 - DNA, 1218 bp, Homo sapiens
gaaaccaccgttcctttttggcgtttcttcgtactcgaaacatggcaggttttaaaccagcagaatattccacagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatattgaacttcaccaacttaaaatctactgcagtgcaaacctcatagctcaagaaacatgttgtgaaatatcagatactaagtgcccagagcaggatggctttggaaatattgcatcatcatgggtaactgctcatgccagtaaaatgtcttcatatctgccagcaaagcaggaacttaaagaccagtgccagtgcattccaaacaagggagaagcaggattaccaggagctccgggttcacctgggcagaaagggcataaaggagagccgggtgaaaatggtttacatggtgctccaggattccctggtcaaaagggagagcaaggttttgaaggcagcaaaggagaaactggtgaaaagggtgaacaaggagaaaaaggagatccagctctggctggccttaatggagaaaatggtttgaaaggtgacttgggtcctcatggtccacctggcccaaaaggagaaaagggagatacaggacccccaggaccaccagccttacctggttccctggggatacaaggcccccaaggtccacctggaaaagagggtcagaggggaagacgagggaaaacaggacctcccggaaaaccaggacccccaggaccacctggacctcctggaatacaaggaatacaccaaactcttggtggatattataacaaggataacaagggaaatgatgaacatgaagctggaggcctgaaaggagacaaggtttaattatcatagctgtaaagatgacagattcacttccccattcaataagatgtttcactcctgtttgattctgaaattgtaatgaccttggattccatgtgaatgtgccattgtcagaaaaaaaatgcacattaaatctacaggcag

SEQ ID NO: 415519 - DNA, 4134 bp, Homo sapiens
actcgcagggagctcactcctcggcggtgccgcagccctgtccggactccactgcgcctctgaggggctcaaatacgaattcaagatccgtggccgttcacatggtttcaaggcacaatgagactcactggcccttggaaactttggctttggatgtcaatatttctgcttcctgcttccacttccgtgaccgttagggacaagacagaagagtcatgccctatcctgagaatagagggacatcagctgacatatgacaacataaacaaacttgaagtttcaggttttgatctaggagacagcttttctctaagacgtgcattttgtgaaagtgataaaacctgtttcaaattgggaagtgcacttcttattagagacactattaagatatttcccaaaggccttcctgaggagtactcagtagctgccatgtttcgagtacgaagaaacgccaaaaaggaacggtggtttctgtggcaggttttaaaccagcagaatattccacagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatattgaacttcaccaacttaaaatctactgcagtgcaaacctcatagctcaagaaacatgttgtgaaatatcagatactaagtgcccagagcaggatggctttggaaatattgcatcatcatgggtaactgctcatgccagtaaaatgtcttcatatctgccagcaaagcaggaacttaaagaccagtgccagtgcattccaaacaagggagaagcaggattaccaggagctccgggttcacctgggcagaaagggcataaaggagagccgggtgaaaatggtttacatggtgctccaggattccctggtcaaaagggagagcaaggttttgaaggcagcaaaggagaaactggtgaaaagggtgaacaaggagaaaaaggagatccagctctggctggccttaatggagaaaatggtttgaaaggtgacttgggtcctcatggtccacctggcccaaaaggagaaaagggagatacaggacccccaggaccaccagccttacctggttccctggggatacaaggcccccaaggtccacctggaaaagagggtcagaggggaagacgagggaaaacaggacctcccggaaaaccaggacccccaggaccacctggacctcctggaatacaaggaatacaccaaactcttggtggatattataacaaggataacaagggaaatgatgaacatgaagctggaggcctgaaaggagacaagggtgaaactggactaccaggatttccagggtctgttggccctaaaggacaaaaaggagaacctggagagccttttacaaaaggagaaaaaggagatagaggagaacctggggtaataggatcacagggagtaaagggtgaacctggagatcccggaccccctggtttaataggaagcccaggactaaagggtcagcaaggatctgcaggctccatgggacccagaggaccgccaggagatgttggattgccaggagaacatggtatcccaggaaaacaaggcattaaaggagaaaagggagatccaggtgggatcataggccctcccgggcttccaggtccaaaaggtgaggctggtcctccagggaaaagcctgccaggggaaccaggattagatggaaatcctggagcacctggtccacgtgggccaaagggtgaaagaggacttccaggtgttcacggttccccaggggacataggcccacaagggataggaattcctggcagaacaggcgcccaaggaccagctggagagccaggtattcagggtcctcgaggtctccctgggttgccaggaactccagggactccagggaatgatggagttccagggagagatggaaagccaggcctgccaggccccccaggtgacccgattgcacttcctctcttgggagacatcggtgctttgctcaagaatttctgtggcaactgccaagccagtgtcccagggctgaaaagcaacaaaggagaagaaggaggtgctggtgagcctggaaagtatgattccatggcccggaagggtgatatagggccacggggtcctccaggaatcccaggaagagagggaccaaagggaagcaaaggagagcggggctaccctgggatacctggggagaaaggtgatgagggtcttcaaggaattccaggcattccaggtgctccaggcccgactggaccccctggcttaatgggaagaactggacatcctggtcccacaggagcaaaaggtgaaaagggcagcgacggaccccctgggaaacccggaccacctggaccacctggtattccatttaatgaacgaaacggcatgagcagtttatataaaattaagggaggtgtgaatgttcccagttacccagggccacccggtcctcctggcccaaaaggcgatcctggcccagtgggagagcctggtgcaatggggttgccaggattagaaggatttccaggtgtaaagggagatcgaggcccagcaggtcccccaggaatagcagggatgtcgggaaaacctggtgccccagggcctccaggagttccaggggaaccgggtgagagaggacctgttggagatataggtttccctggaccagaaggaccctcaggaaagccaggaataaatggaaaagatggaataccaggtgctcagggcatcatgggtaagcctggagacagaggccccaaaggagaacgtggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggctgatgcagtttcatttgaagaaataaagaagtatattaatcaagaggtcctaaggatttttgaagagaggatggctgtattcctatcccagctcaagctgccagcagcaatgttggctgcccaagcttatgggagacctgggccaccagggaaggatgggttgcctgggccaccaggagaccctggaccccaaggctacagaggacagaagggagaaagaggtgaacctggaattgggctgccagggagtccaggtcttcctgggacttcagctctgggtttgccaggctcaccaggtgccccaggcccccagggccccccaggacccagtggaagatgtaacccagaagattgcctctatcctgtgtctcatgcccatcagcgcacaggtgggaattgaacacacctgaagaagacttagttcctggtaacatttccttgccactggagctctcttaataccgtcaaaccctcatcatctgtgggttgctttttttttttttttttttttttgggagtaagccaggcattaaaagcaaccgtttgaatcctattcctatagcaattgcaaatcagcattttttgatttttcccaaattcattccatatgttttgctttacaattgctatgatttttactcagagttttatatgaaatatgcaagtaaatcttatcgttagttcttcttcaaaaggaaattgcatcttgtgacttagtagactgatgatgatatccattttgtagactcatcaacatgtggttggcctttgatttctgaattttaaagtttcagacttatcttttccttggtgtttaaatttactatcattgctaaacatctcgtcaacttttttgatatagtgcattgctcctgttgaatgttttttgactactttttataacttaagaatttttataccatctacatctatcctacttatgcagaaaaataggcaataagaacttcattttacaatttagttttca

SEQ ID NO: 415520 - DNA, 369 bp, Homo sapiens
cggcgccgggcggcccagctagggcgctgcagggtcgcgaggaagtttgttggcccggaaccaagcacgccgtcgggcacgctagctccccgagagcaggcgggcgcatccgtggccgttcacatggtttcaaggcacaatgagactcactggcccttggaaactttggctttggatgtcaatatttctgcttcctgcttccacttccgtgaccgttagggacaagacaggtatccaggccaactctttgcctaatcaccaaatgttatttatagcctttaagtcattaaaacaaatcttgttaagattgaaaaggccatagattaatgtactataacagaataaattacaattcattgctttcttcca

SEQ ID NO: 415521 - DNA, 1245 bp, Homo sapiens
catacctggaccttctttatttcttcaaatgaaactgcatcagccggaatgccagggatgcctggaggccccaaaggagaacgtggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggctgatgcagtttcatttgaagaaataaagaagtatattaatcaagaggtcctaaggatttttgaagagaggatggctgtattcctatcccagctcaagctgccagcagcaatgttggctgcccaagcttatgggagacctgggccaccagggaaggatgggttgcctgggccaccaggagaccctggaccccaaggctacagaggacagaagggagaaagaggtgaacctggaattgggctgccagggagtccaggtcttcctgggacttcagctctgggtttgccaggctcaccaggtgccccaggcccccagggccccccaggacccagtggaagatgtaacccagaagattgcctctatcctgtgtctcatgcccatcagcgcacaggtgggaattgaacacacctgaagaagacttagttcctggtaacatttccttgccactggagctctcttaataccgtcaaaccctcatcatctgtgggttgctttttttttttttttttttttttgggagtaagccaggcattaaaagcaaccgtttgaatcctattcctatagcaattgcaaatcagcattttttgatttttcccaaattcattccatatgttttgctttacaattgctatgatttttactcagagttttatatgaaatatgcaagtaaatcttatcgttagttcttcttcaaaaggaaattgcatcttgtgacttagtagactgatgatgatatccattttgtagactcatcaacatgtggttggcctttgatttctgaattttaaagtttcagacttatcttttccttggtgtttaaatttactatcattgctaaacatctcgtcaacttttttgatatagtgcattgctcctgttgaatgttttttgactactttttataacttaagaatttttataccatctacatctatcctacttatgcagaaaaataggcaataagaacttcattttacaatttagttttca

SEQ ID NO: 415522 - DNA, 1239 bp, Homo sapiens
agcggatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaa

SEQ ID NO: 415523 - DNA, 820 bp, Homo sapiens
  misc_feature (42)..(42): n is a, c, g, or t
tgagatcaatatacatctgaacagagtattattttataagtntgcccctctcaagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaa

SEQ ID NO: 415524 - DNA, 818 bp, Homo sapiens
agcggatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagca

SEQ ID NO: 415525 - DNA, 963 bp, Homo sapiens
  misc_feature (42)..(42): n is a, c, g, or t
tgagatcaatatacatctgaacagagtattattttataagtntgcccctctcaagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaatctaaaaaaacacaaccgcaccgacaccaatacatgattaaaatgtctattggctcccgggggctctcgcgcgtcctttagggggggatttatggcccgtcctactccctccaggccctaggtgaggaaggtaatttataagg

SEQ ID NO: 415526 - DNA, 399 bp, Homo sapiens
  misc_feature (42)..(42): n is a, c, g, or t
tgagatcaatatacatctgaacagagtattattttataagtntgcccctctcaagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagca

SEQ ID NO: 415527 - DNA, 816 bp, Homo sapiens
tattaatattacaccacactcacaaactcaaaacgttctagttgataacagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaa

SEQ ID NO: 415528 - DNA, 818 bp, Homo sapiens
  misc_feature (20)..(20): n is a, c, g, or t
ggaacaaatggagaagatgntaagtagatagaagagggcgctgctgatgccagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaa

SEQ ID NO: 415529 - DNA, 834 bp, Homo sapiens
  misc_feature (55)..(55): n is a, c, g, or t
  misc_feature (65)..(65): n is a, c, g, or t
  misc_feature (69)..(69): n is a, c, g, or t
tataggttatattgtggctagattacagtatgaaaaggaaggacgggggtttagntgaaacacangagnttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaa

SEQ ID NO: 415530 - DNA, 819 bp, Homo sapiens
cggcgaggacgttactcatgcacagcgctctgacacacgaccggcgacgccttattaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaa

SEQ ID NO: 415531 - DNA, 405 bp, Homo sapiens
tattgatgggggtggttgggggcgtggggggtgagggagggggggcttagtgaaaactcagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagca

SEQ ID NO: 415532 - DNA, 395 bp, Homo sapiens
tattaatattacaccacactcacaaactcaaaacgttctagttgataacagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagca

SEQ ID NO: 415533 - DNA, 416 bp, Homo sapiens
  misc_feature (30)..(30): n is a, c, g, or t
  misc_feature (68)..(69): n is a, c, g, or t
tatataaaggtaatgtaaagggacgaagtntaaaagtaaaacaccagcccccctgtatgatccccagnnagattaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagca

SEQ ID NO: 415534 - DNA, 405 bp, Homo sapiens
tggaaggtgtaggtggcgtgaggcagtgcggggatagacgatggggccccggtccctctgattaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagca

SEQ ID NO: 415535 - DNA, 399 bp, Homo sapiens
ttagaatggccaaccacgtgtacactgcgcctcatcacaaagcttattgataacattaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagca

SEQ ID NO: 415536 - DNA, 702 bp, Homo sapiens
agcggatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtg

SEQ ID NO: 415537 - DNA, 655 bp, Homo sapiens
agcggatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtg

SEQ ID NO: 415538 - DNA, 236 bp, Homo sapiens
  misc_feature (42)..(42): n is a, c, g, or t
tgagatcaatatacatctgaacagagtattattttataagtntgcccctctcaagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtg

SEQ ID NO: 415539 - DNA, 243 bp, Homo sapiens
ggatagtgacgaggaagttgcatttaagaagacagaagagggggctgcttatggcacgtaggttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtg

SEQ ID NO: 415540 - DNA, 312 bp, Homo sapiens
  misc_feature (31)..(31): n is a, c, g, or t
  misc_feature (44)..(44): n is a, c, g, or t
  misc_feature (58)..(58): n is a, c, g, or t
  misc_feature (74)..(74): n is a, c, g, or t
agtcatgataccaggtaaacaggagtatagntcaagagggaatntcgcaagaggcggntgcgctagtgtgaatnccagcggagattaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtg

SEQ ID NO: 415541 - DNA, 289 bp, Homo sapiens
  misc_feature (28)..(28): n is a, c, g, or t
  misc_feature (42)..(44): n is a, c, g, or t
  misc_feature (46)..(46): n is a, c, g, or t
ttaatgttattcacgtaccgctcaaggnagtacataagaggnnncncgtcgttggataacattaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtg

SEQ ID NO: 415542 - DNA, 283 bp, Homo sapiens
  misc_feature (42)..(42): n is a, c, g, or t
tgagatcaatatacatctgaacagagtattattttataagtntgcccctctcaagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtg

SEQ ID NO: 415543 - DNA, 964 bp, Homo sapiens
  misc_feature (42)..(42): n is a, c, g, or t
tgagatcaatatacatctgaacagagtattattttataagtntgcccctctcaagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaaaaaaaaaatggctcttggctcacggtggcctttgcgcgcttccttaggaggtaatttagacctgctcctgctctcggctgggcgtcggtggggaggggttcactcccaaggcggatcggtatcccaaccgggaaaccagaacat

SEQ ID NO: 415544 - DNA, 911 bp, Homo sapiens
  misc_feature (42)..(42): n is a, c, g, or t
tgagatcaatatacatctgaacagagtattattttataagtntgcccctctcaagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaaaaaaaaacaaagaggcctctttggccccacagggggagctttgcgggccttctctttatgagggtgaatcacaaacctccttcctgactcc

SEQ ID NO: 415545 - DNA, 1014 bp, Homo sapiens
agcggatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaa

SEQ ID NO: 415546 - DNA, 837 bp, Homo sapiens
  misc_feature (30)..(30): n is a, c, g, or t
  misc_feature (68)..(69): n is a, c, g, or t
tatataaaggtaatgtaaagggacgaagtntaaaagtaaaacaccagcccccctgtatgatccccagnnagattaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccaaa

SEQ ID NO: 415547 - DNA, 858 bp, Homo sapiens
  misc_feature (826)..(827): n is a, c, g, or t
  misc_feature (841)..(841): n is a, c, g, or t
agcggatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcagaaaaaannaaaaaatggcctgnttggcctgagcgggggc

SEQ ID NO: 415548 - DNA, 1453 bp, Homo sapiens
  misc_feature (1453)..(1453): n is a, c, g, or t
agcggatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatcccaggaagatattctttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcaaaaaaaaaaaaaaaaaaaaaaaaaaaaaaaaaaaaaaaaaaaaaaaaaaaaacaaaacaagacaaaaaacaaagaagagaaagacaaaccaaaacaacacaagtcaagcaagaaaacaagaaagagaggggggaccgacaaaataaaatacacaagacaggaagcgacacaaataagcagacgcaccccaaagtgataaaagaagaagcgccaccaaacgatggattaacaacaaaacgacgcgcggcgcgaacaaaaaaggtcaccggggagacaacacgcccgagctgctgcgtggaggacgaaccccacaagggtgggggagaaaagaagagaccaaacccaccaacaagaagatggcgcgcagccaaaaacaaaaaagcgagtagtggtgaagaacacacacgatcacagcgagggcagaagagacgcacacgaaactaaacaaaaaaacacaacggggccggacaaaaacagcagtcgagccagataagcagcaaacagcgcaaagcacagcagcacacgagcgcaaaccggcggccaaacacgacacaaagcacgaagcacacacagatgaagaagccaagcacacacacgacaaaaaaggccacacaacagacaccgaaacaccatcn

SEQ ID NO: 415549 - DNA, 540 bp, Homo sapiens
atttttcatctgtgatatatatatcatttatatatttctgccatcattttaatttccttgctttcttactttgctctgtgtgtacacacataagtgcatgtatatgtgaatataactattgcattttattaaacagaagttatgagatattggcagtatacaactttgtgaactgatgttactaaataaataacactatatttattagactggagtagcaattagaccctaaatgtgatggtttagcacactaggaattcatttcttgctcatgtaacacaagttttaattgcaggggtttttttaatatatttcagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactggg

SEQ ID NO: 415550 - DNA, 301 bp, Homo sapiens
gccaccacgcctggttaattttttgtatttttagtagaggcggggtttcaccgtgttagccaggatggtctcgatctcctgaccttgtgatctgcctgcctcagcctcccaaagtgctgggattacaggcatgagccactgcgcccggctgacacagagctgaagttctatccttcatgtcgcattgtatctggagacagcgtctgcataggtcactagcagtgaagcgaagtttgatcacttggtggaggcagtgactgctggatctttccactgtaaaggcacacgtttcccttcgcca

SEQ ID NO: 415551 - DNA, 291 bp, Homo sapiens
tgtaccatctatgtgcaattatactctaaattccactacactacattaaagtaaatggacattccagaatatagatgtgattatagtcttaaactaattattattaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaa

SEQ ID NO: 415552 - DNA, 1008 bp, Homo sapiens
  misc_feature (787)..(787): n is a, c, g, or t
cgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagttgtaggtgnaccggtcagtggagcgaaagggattaatgggacctccctcgggagaaccaaggggaaagcttgaaccattccgggtcccccacggtggaccaaggccaggggacacccttcatcatagaagaggcggaaccaggaacattatgagatggcacaaacggcaatgaagggaaccctccgaactgggatggcaaatgccttcgaccagaagatcccggagagaa

SEQ ID NO: 415553 - DNA, 1826 bp, Homo sapiens
cactttttttagagccttgtttaaaggaacgttaactcgagagtactactgatgatgacgcttctcttgtttttaaagtatttacacatcattgttaagtatttttggaatggaacattttaaagttttctccatagaaagcaacatagtggcacttgttgagtaaatgatcataaaaatgacttgcttttaatagcagatgagttgatagtttaactgttgacactttcttaatgtttttgatgttggatgcatttacaatggaagaatttttttgaaagatttggccctctcaccaatacacacattcagacttgagctgcacgcatttagatgaacaaataggaaattcacggtattttttgttttagccatccaaaattcataggattctaccaaaaatattagcccctgactctagttattctgagatgagggaatcaactttatcttgaaagttaactagctaaaatgtctttatttaaatagcaaaaatatagtttacctgacaagtattaaaagtctcactttcaaattgtgttaactctcagaccactgatgaatcttttggtaaatcacaggcagattttaaaagctaaatgaagccttagtgccttgaaagttaagatacttgtgcaaaatggatttagcaagattcaggattggcaccagtgagttggctagatacacatcacctgtgactgggaattcaaagtttagaaagcctaacgaatagtagctactaacttcatatggttcaatgtaaatcagttacttagtcattgactgtgacagatgacagctactttcactatattttcatgatgtggtatttttctctattttttctttttccaagtatgaaatggaaaaaaatgtagttaagaaaattaagtgtgagactttaaaatttagttttgttgtaaactagagattctagtgaacagtgttagttttatactgtagtacagggcacacactttaacctttagaaatatgtttaccatcagggatttatttttactatagaaatactaaatgtactgtgaagcttaaagacaggagaataaatgttggaggggtaatacacaaaaacaaaggcatatttgatgaagtaccctgtgttatgtgaacacaatttccccttctgttaagactataaactatatgagtatgtgtactgcatgtttacataaaacagtttaattttgaaggattattttaaaaactatgtttatatataatacctaacaagctgtaaatattgtatattattgatttttaattttatataagcaattttttatttcccaattcatgtacaaatctcattatgtatatagcataatttcctggagaacacaaattttgcagtgaattttaagtaattttaattgcagtaagcatcagtttagcctagagatgttgatctttattttaaattatttttcaccattctcattttcttcaaagggcagcaataaacatatgcaagttatttttaattatagaaagtaggtctacaaagataagatctaggttccaattcattgctttaaggaaaagatgcacaattactatcattcagtgtctaatcacaggaccatttctgaggtccacatgtggctctcctctttgtaatatacagggtgaactctttactgatacacacaagacaactgttaaaaagtgaatccagcacttaaatgtcattacacagaatttattggattaaaaatttgtaatatacagtattttaataaagtttctgtattcaatttcatgcacttatatataaataaacctgtctttgaaagctttaaaag

SEQ ID NO: 415554 - DNA, 1766 bp, Homo sapiens
cactttttttagagccttgtttaaaggaacgttaactcgagagtactactgatgatgacgcttctcttgtttttaaagtatttacacatcattgttaagtatttttggaatggaacattttaaagttttctccatagaaagcaacatagtggcacttgttgagtaaatgatcataaaaatgacttgcttttaatagcagatgagttgatagtttaactgttgacactttcttaatgtttttgatgttggatgcatttacaatggaagaatttttttgaaagatttggccctctcaccaatacacacattcagacttgagctgcacgcatttagatgaacaaataggaaattcacggtattttttgttttagccatccaaaattcataggattctaccaaaaatattagcccctgactctagttattctgagatgagggaatcaactttatcttgaaagttaactagctaaaatgtctttatttaaatagcaaaaatatagtttacctgacaagtattaaaagtctcactttcaaattgtgttaactctcagaccactgatgaatcttttggtaaatcacaggcagattttaaaagctaaatgaagccttagtgccttgaaagttaagatacttgtgcaaaatggatttagcaagattcaggattggcaccagtgagttggctagatacacatcacctgtgactgggaattcaaagtttagaaagcctaacgaatagtagctactaacttcatatggttcaatgtaaatcagttacttagtcattgactgtgacagatgacagctactttcactatattttcatgatgtggtatttttctctattttttctttttccaagtatgaaatggaaaaaaatgtagttaagaaaattaagtgtgagactttaaaatttagttttgttgtaaactagagattctagtgaacagtgttagttttatactgtagtacagggcacacactttaacctttagaaatatgtttaccatcagggatttatttttactatagaaatactaaatgtactgtgaagcttaaagacaggagaataaatgttggaggggtaatacacaaaaacaaaggcatatttgatgaagtaccctgtgttatgtgaacacaatttccccttctgttaagactataaactatatgagtatgtgtactgcatgtttacataaaacagtttaattttgaaggatatttttaattttatataagcaattttttatttcccaattcatgtacaaatctcattatgtatatagcataatttcctggagaacacaaattttgcagtgaattttaagtaattttaattgcagtaagcatcagtttagcctagagatgttgatctttattttaaattatttttcaccattctcattttcttcaaagggcagcaataaacatatgcaagttatttttaattatagaaagtaggtctacaaagataagatctaggttccaattcattgctttaaggaaaagatgcacaattactatcattcagtgtctaatcacaggaccatttctgaggtccacatgtggctctcctctttgtaatatacagggtgaactctttactgatacacacaagacaactgttaaaaagtgaatccagcacttaaatgtcattacacagaatttattggattaaaaatttgtaatatacagtattttaataaagtttctgtattcaatttcatgcacttatatataaataaacctgtctttgaaagctttaaaag

SEQ ID NO: 415555 - DNA, 6249 bp, Homo sapiens
  misc_feature (3404)..(3404): n is a, c, g, or t
  misc_feature (4001)..(4001): n is a, c, g, or t
  misc_feature (4434)..(4434): n is a, c, g, or t
  misc_feature (4437)..(4437): n is a, c, g, or t
  misc_feature (4485)..(4485): n is a, c, g, or t
cggacgcgtggggcaatttattgtctaaaatagcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtccgatgagtgtcagttacaagggcagagaaggtaccagtgcagaagagctctgactgtgggcagtgtcaccaggtcccactaagtggcaacacttgtgctgggcgacttgacccatcttgatgtataaacccatagccagacaggacgtgcaaacaggtctcatggtgaatgcgatgctgtggaaaatgacatggagaatggctgtctctcagctagggaggagggtcttggtgtcctaggaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaatttttccagtggaaaaaggaaaagactggtacaaatcctgatatttaagcttcccttggaaaacactttaacagttcattttgcatgctagagcaaacgagacaagaaataatgtgttttattgatttcaaggaagtggttaatcattagtccttttgagttttcccgcaagaatctgtgaaattgctcatttatctggtagcaaatcgtcagtgaggtctcacagatagttaggtcttgattttactctcaggacttaaggacatgcttctagaaaacagaaagcagatgtcacgtttgttaaagagaacaatgccaggcttgacttgcaattattatttaaataccttatcttccctaaagtcttaaaaatgttatattagggatgggttgctcatttggttagaggaactctcattaaggctcaaattaagaatttaactcacctctccagagagctttgcccattgaagacaaaccaatgcatagacttatacccagccctgcactgttagggctctacttggccatgagcagggttagtgtgaaaccaatcaacaagtattgtttgttgttgttgttgttgttttgagatggagtttcgctcttgttgcccaggcttgagtgcagtgatgcaatcttggctcaccgcagcctccgcctcctggggtcaggctgttctcctgcctgggtctcccgagtggctgggattataggcgtgcaccaccacgccctgctaattttgcatttttggtggagacggggtttctccatgttggtcaggctggtcttgaactcccggactcgggtgatccacccgcctcggcctcccagagtgctgagatttacaggcgtgagccaccgcgcccggccagtattgctttattacacaaggcacagtgttagggcctgtgaccatgacgttttttcaggtaatatttcttccttgagctaaggaggccagttgtaggaatgagcactagaaagcaagaatgtcaacagtgttagatggattttatatgattcattacttcaagagagaaaattcatattgtgtggttgatggaattccttacctttttaaaatcagattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtattttacaggtgacatgttacttcgttcttgaattcgtacgctgttaagttttgcaacttgaaacctagacacaaggtcaaattgctggaagagtcctcagaggtccacctcttaccctacagactggccgagaccatatcaagtattaaaaccattctatacagcaagtatcgtttatcctttcttaaacaccgagtctccaaaaatacttagtttagctttagtttagtaagttcagaagtagaaacaaacttatttaaaaccatcatttgaaagtttaattctttaaatttgtctcttagttttgtgaattttgaataataatgtttaaattttgtttcngtcatttaaaatttaaattttcagtcatttaaaattttaaaaatttaaaatttcacaaaactaagggtaaaagacatttaaagaattaaacttaaataagtgtgtgcagcatttctacttctgaagttattaaagctaaaactgcactaagccttttgagacatcctttattcttaaaaagctcataaataattggcttattacatataaacttcaaaaaagtgggttataagacattgctttagaatcttgcccctccaaatcttccctcaaagatcttaatgagtaaaacaactgctacatacatatgcagaatgtgtaataaaacaaaaagcaattgctatatgaaaatattcgtaagaaaagtaaagcaaattgtttctttgtgcttcagctcattttccatatttttaaaaccctgtggtaaaagcctcaatgaaatcatttacaagaactacaattaaatattgttaaaattagcaaaaggctttccgtatatagatgacatctatgaaggcaaaaggtgacagtaaaaacagtaagatccatatgcataagattgtacaaggctattcatttgtgaaacaaatatacatntcgaagacaggtctcagagataccttaactattcctttttttataaacatattaaaggatgtggctttattttataaatcacaaccatcccaacagtggatttaaacaagatttctttttagtaatgggaaaatgcaattaatatggaggtgatagtcactaagaactgttgaatggcagaaaagtatttgctctcgttttatgttctggcttgtctgtattgcctgaacttcattttgtctttgtgtaagggaagaaatttcaacagactcgggtttgagatatcctcaaatggtcatgtatttctgtctcaaatctcttaataccacccatgtaacattccttcaaccacttgaagatccaaattcccaactagtattctcttctccacacttaatccagttcctaaagattattattattattattattnttntttttttttttttgagacggagtctcctgacctaatcttagcccggcncagtggctcacgtctgtaatcccagcactttgggaggctgaggcgggcagatcatgaggtcaggagtttgagaccaggctggccaacgtggtgaaaccccgtctctactaaaaatacaaaaattagccgggcgtgatggcggacgcctgtagtcccagctactcgggaggctgagacagaagaactgcttgaaaccaggaggcagaggttgcagtgagctgagatcgcgcaaattgcactccagcctcggtgacaagagcgagactccatctcaaaaaaaaataaaaagaatcttaaaataggaacataataaaagatcggccctaagtaaagagcactttttaaactgccattaaagatgggtttcagaaatcataaactttgacgtgtgccatacatggtaacatgctatgcttatatgtcttctataaatccaatgcagaatttaaaatttcagtttactctagttaccataaagctaatgctctggcacaagcgagtccctgcaaactaccactgctgaggacagtagtaaaccccttgacctgagactgcggtgagtctgtaactcgagtgcattgagacttccagatcattactcttacacacacacacacacacacatacacacacacacactccttctctaagattccttgtagctgatatctcatggaaaaatgacattttatcataaataaatatagagacaaaataatagtgatctttctcattcgcaatgtaaacttaacagctacagtttaaatgatagcatagaattatgcctaaaatagacatttcccataattgtattgtgataagttcttcaggcttgacaacttcacattgcctctcttccttgaatgtattttatctggtcttttctatatagtcttttgaaggataatttttatcaatagccaactttgggtatttttttaagtgtcaaatatcatcatggtttgaaaaaaggataaaaaagctataactaaaaaaatcttaaggataacatttggtttactaatttttaatcatttatctttcagaacttgtttcttatcaagaagttagcaggtatgatatgtatatcatacgtatataaactggcataggttacatcctagggcatgaggggagtatctttcagggattcaaatggaatttttacctgttacttgtttaattgttttgttttcaatattcttggggattagacaggggaaggtattttattactgcataatagatggtgaaacccaggaaaattaagtacttgtgcatggccccactatcaataacacaaagtctgtactctggatctcccctaatgtccctgtggtctaaacggcttgataatacaaccgagcccctgaagtagctgccctcctctttccgctcccccatctcggccctgcccatactccaagggtcagctcccatctctcctccctaatgcctcacttcaagcactaatttggctctttctgctcactaaaaatcatatattttacagatttattttgtttctggagaaggcagcaaacttttacttccctgcagaagtagttaagtacatagtgttttctctaaaaaggcatttgataaatatttgaacagcctgtagagtttcaacctctttgagatataagtatcttaaatatcatagagcactgtgattcatttttatattttattgctttgaatgctcaaactatgggaaatctttggtaaaaataaagacaataaaatcttcacaataacttt

SEQ ID NO: 415556 - DNA, 5187 bp, Homo sapiens
  misc_feature (2342)..(2342): n is a, c, g, or t
  misc_feature (2939)..(2939): n is a, c, g, or t
  misc_feature (3372)..(3372): n is a, c, g, or t
  misc_feature (3375)..(3375): n is a, c, g, or t
  misc_feature (3423)..(3423): n is a, c, g, or t
cggacgcgtggggcaatttattgtctaaaatagcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtccgatgagtgtcagttacaagggcagagaaggtaccagtgcagaagagctctgactgtgggcagtgtcaccaggtcccactaagtggcaacacttgtgctgggcgacttgacccatcttgatgtataaacccatagccagacaggacgtgcaaacaggtctcatggtgaatgcgatgctgtggaaaatgacatggagaatggctgtctctcagctagggaggagggtcttggtgtcctaggaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaatttttccagtggaaaaaggaaaagactgattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtattttacaggtgacatgttacttcgttcttgaattcgtacgctgttaagttttgcaacttgaaacctagacacaaggtcaaattgctggaagagtcctcagaggtccacctcttaccctacagactggccgagaccatatcaagtattaaaaccattctatacagcaagtatcgtttatcctttcttaaacaccgagtctccaaaaatacttagtttagctttagtttagtaagttcagaagtagaaacaaacttatttaaaaccatcatttgaaagtttaattctttaaatttgtctcttagttttgtgaattttgaataataatgtttaaattttgtttcngtcatttaaaatttaaattttcagtcatttaaaattttaaaaatttaaaatttcacaaaactaagggtaaaagacatttaaagaattaaacttaaataagtgtgtgcagcatttctacttctgaagttattaaagctaaaactgcactaagccttttgagacatcctttattcttaaaaagctcataaataattggcttattacatataaacttcaaaaaagtgggttataagacattgctttagaatcttgcccctccaaatcttccctcaaagatcttaatgagtaaaacaactgctacatacatatgcagaatgtgtaataaaacaaaaagcaattgctatatgaaaatattcgtaagaaaagtaaagcaaattgtttctttgtgcttcagctcattttccatatttttaaaaccctgtggtaaaagcctcaatgaaatcatttacaagaactacaattaaatattgttaaaattagcaaaaggctttccgtatatagatgacatctatgaaggcaaaaggtgacagtaaaaacagtaagatccatatgcataagattgtacaaggctattcatttgtgaaacaaatatacatntcgaagacaggtctcagagataccttaactattcctttttttataaacatattaaaggatgtggctttattttataaatcacaaccatcccaacagtggatttaaacaagatttctttttagtaatgggaaaatgcaattaatatggaggtgatagtcactaagaactgttgaatggcagaaaagtatttgctctcgttttatgttctggcttgtctgtattgcctgaacttcattttgtctttgtgtaagggaagaaatttcaacagactcgggtttgagatatcctcaaatggtcatgtatttctgtctcaaatctcttaataccacccatgtaacattccttcaaccacttgaagatccaaattcccaactagtattctcttctccacacttaatccagttcctaaagattattattattattattattnttntttttttttttttgagacggagtctcctgacctaatcttagcccggcncagtggctcacgtctgtaatcccagcactttgggaggctgaggcgggcagatcatgaggtcaggagtttgagaccaggctggccaacgtggtgaaaccccgtctctactaaaaatacaaaaattagccgggcgtgatggcggacgcctgtagtcccagctactcgggaggctgagacagaagaactgcttgaaaccaggaggcagaggttgcagtgagctgagatcgcgcaaattgcactccagcctcggtgacaagagcgagactccatctcaaaaaaaaataaaaagaatcttaaaataggaacataataaaagatcggccctaagtaaagagcactttttaaactgccattaaagatgggtttcagaaatcataaactttgacgtgtgccatacatggtaacatgctatgcttatatgtcttctataaatccaatgcagaatttaaaatttcagtttactctagttaccataaagctaatgctctggcacaagcgagtccctgcaaactaccactgctgaggacagtagtaaaccccttgacctgagactgcggtgagtctgtaactcgagtgcattgagacttccagatcattactcttacacacacacacacacacacatacacacacacacactccttctctaagattccttgtagctgatatctcatggaaaaatgacattttatcataaataaatatagagacaaaataatagtgatctttctcattcgcaatgtaaacttaacagctacagtttaaatgatagcatagaattatgcctaaaatagacatttcccataattgtattgtgataagttcttcaggcttgacaacttcacattgcctctcttccttgaatgtattttatctggtcttttctatatagtcttttgaaggataatttttatcaatagccaactttgggtatttttttaagtgtcaaatatcatcatggtttgaaaaaaggataaaaaagctataactaaaaaaatcttaaggataacatttggtttactaatttttaatcatttatctttcagaacttgtttcttatcaagaagttagcaggtatgatatgtatatcatacgtatataaactggcataggttacatcctagggcatgaggggagtatctttcagggattcaaatggaatttttacctgttacttgtttaattgttttgttttcaatattcttggggattagacaggggaaggtattttattactgcataatagatggtgaaacccaggaaaattaagtacttgtgcatggccccactatcaataacacaaagtctgtactctggatctcccctaatgtccctgtggtctaaacggcttgataatacaaccgagcccctgaagtagctgccctcctctttccgctcccccatctcggccctgcccatactccaagggtcagctcccatctctcctccctaatgcctcacttcaagcactaatttggctctttctgctcactaaaaatcatatattttacagatttattttgtttctggagaaggcagcaaacttttacttccctgcagaagtagttaagtacatagtgttttctctaaaaaggcatttgataaatatttgaacagcctgtagagtttcaacctctttgagatataagtatcttaaatatcatagagcactgtgattcatttttatattttattgctttgaatgctcaaactatgggaaatctttggtaaaaataaagacaataaaatcttcacaataacttt

SEQ ID NO: 415557 - DNA, 3591 bp, Homo sapiens
cggacgcgtggggcaatttattgtctaaaatagcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtccgatgagtgtcagttacaagggcagagaaggtaccagtgcagaagagctctgactgtgggcagtgtcaccaggtcccactaagtggcaacacttgtgctgggcgacttgacccatcttgatgtataaacccatagccagacaggacgtgcaaacaggtctcatggtgaatgcgatgctgtggaaaatgacatggagaatggctgtctctcagctagggaggagggtcttggtgtcctaggaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaatttttccagtggaaaaaggaaaagactggtacaaatcctgatatttaagcttcccttggaaaacactttaacagttcattttgcatgctagagcaaacgagacaagaaataatgtgttttattgatttcaaggaagtggttaatcattagtccttttgagttttcccgcaagaatctgtgaaattgctcatttatctggtagcaaatcgtcagtgaggtctcacagatagttaggtcttgattttactctcaggacttaaggacatgcttctagaaaacagaaagcagatgtcacgtttgttaaagagaacaatgccaggcttgacttgcaattattatttaaataccttatcttccctaaagtcttaaaaatgttatattagggatgggttgctcatttggttagaggaactctcattaaggctcaaattaagaatttaactcacctctccagagagctttgcccattgaagacaaaccaatgcatagacttatacccagccctgcactgttagggctctacttggccatgagcagggttagtgtgaaaccaatcaacaagtattgtttgttgttgttgttgttgttttgagatggagtttcgctcttgttgcccaggcttgagtgcagtgatgcaatcttggctcaccgcagcctccgcctcctggggtcaggctgttctcctgcctgggtctcccgagtggctgggattataggcgtgcaccaccacgccctgctaattttgcatttttggtggagacggggtttctccatgttggtcaggctggtcttgaactcccggactcgggtgatccacccgcctcggcctcccagagtgctgagatttacaggcgtgagccaccgcgcccggccagtattgctttattacacaaggcacagtgttagggcctgtgaccatgacgttttttcaggtaatatttcttccttgagctaaggaggccagttgtaggaatgagcactagaaagcaagaatgtcaacagtgttagatggattttatatgattcattacttcaagagagaaaattcatattgtgtggttgatggaattccttacctttttaaaatcagattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaaggtaatcctacctgagaacaagattaggtttgaaggaaatgctgaaaccgagaataacatgcctcactttctcttgtagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggtgaatgtctttgtctgttctgtgctgctgtaacagaatatcacacactaggtaatttatgagaaacagaaatttatttctcacagttccagaggccaggagagggctgcaacctccagaggggaggaccatcatgtcctcacgtgacagcagaaagctacaggaaacctcttttataaaaagggctttagtcctattcatgagggaggtgctctcatggcctcgtcgcctcttaagagccccacctcttgatacgatcacactagcaacactgggatttccaagggaacttactagtcaaaccatagcagtaatgtttgaataaactggatgaaagtattgataagaatgcctactacatgttctatgccaaatccttcacagagctttctgcagtattagaaatgatagctattgagcacttgaaatgtgtctaatgcaacttagcactaaacttttaaattttacttaatgtaaatattcatatggctggtggttaccatactggatagcacaattctatgccattagccttcaggatttcagtgctactagctgaagcaagttttttaagcagcaattgccttatctgtaagaagagaatacctttatagcaggattataatcatgtacttaacacagcttggcatgtcacacatttattacgtcttcatttcttcctgcactcctcggtcatgcagttctataactgcaccactgaaatacagcttcataacaactgtaacatgagaatatggttaaaagactgacactatatctaataaaatataaaagacgtctttt

SEQ ID NO: 415558 - DNA, 2834 bp, Homo sapiens
cggacgcgtggggcaatttattgtctaaaatagcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtccgatgagtgtcagttacaagggcagagaaggtaccagtgcagaagagctctgactgtgggcagtgtcaccaggtcccactaagtggcaacacttgtgctgggcgacttgacccatcttgatgtataaacccatagccagacaggacgtgcaaacaggtctcatggtgaatgcgatgctgtggaaaatgacatggagaatggctgtctctcagctagggaggagggtcttggtgtcctaggaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaatttttccagtggaaaaaggaaaagactggtacaaatcctgatatttaagcttcccttggaaaacactttaacagttcattttgcatgctagagcaaacgagacaagaaataatgtgttttattgatttcaaggaagtggttaatcattagtccttttgagttttcccgcaagaatctgtgaaattgctcatttatctggtagcaaatcgtcagtgaggtctcacagatagttaggtcttgattttactctcaggacttaaggacatgcttctagaaaacagaaagcagatgtcacgtttgttaaagagaacaatgccaggcttgacttgcaattattatttaaataccttatcttccctaaagtcttaaaaatgttatattagggatgggttgctcatttggttagaggaactctcattaaggctcaaattaagaatttaactcacctctccagagagctttgcccattgaagacaaaccaatgcatagacttatacccagccctgcactgttagggctctacttggccatgagcagggttagtgtgaaaccaatcaacaagtattgtttgttgttgttgttgttgttttgagatggagtttcgctcttgttgcccaggcttgagtgcagtgatgcaatcttggctcaccgcagcctccgcctcctggggtcaggctgttctcctgcctgggtctcccgagtggctgggattataggcgtgcaccaccacgccctgctaattttgcatttttggtggagacggggtttctccatgttggtcaggctggtcttgaactcccggactcgggtgatccacccgcctcggcctcccagagtgctgagatttacaggcgtgagccaccgcgcccggccagtattgctttattacacaaggcacagtgttagggcctgtgaccatgacgttttttcaggtaatatttcttccttgagctaaggaggccagttgtaggaatgagcactagaaagcaagaatgtcaacagtgttagatggattttatatgattcattacttcaagagagaaaattcatattgtgtggttgatggaattccttacctttttaaaatcagattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaaggtaatcctacctgagaacaagattaggtttgaaggaaatgctgaaaccgagaataacatgcctcactttctcttgtagactgtggcttatcgcagcagacaatggaaatcccaaagctagtgtgaaggctcaaagtatgctcgggctgtattactcaaccaaggagcccaaggagttagaaaaggtaacgttccctcttttttaatgctacggtattatgatgatagagttagcatactgctacgcaaccacttggcatccaactgcacaggacactctaatttttctcaaattcacgcgaggaccatagagaacaagacagggaatgatctgctgtggatcaggggagcccagaaatgggcagggtctagagaagtgagacacaacttcagctgcagtcctggagccacaaggagtactgtagaaattattgagacctgggttctactccgcgt

SEQ ID NO: 415559 - DNA, 4402 bp, Homo sapiens
  misc_feature (1557)..(1557): n is a, c, g, or t
  misc_feature (2154)..(2154): n is a, c, g, or t
  misc_feature (2587)..(2587): n is a, c, g, or t
  misc_feature (2590)..(2590): n is a, c, g, or t
  misc_feature (2638)..(2638): n is a, c, g, or t
tgccagagaagaaagcaagcaaggccgcttcctgcggctaagtggacaggcgactgcttgcagggatccgggggtgcgttgaccgaggcccctgtctccagcaaatgcttcagaccatccacctgcaggaagagaacagatccagcacccttcccacctttgtccagtcccgcgcccctccgggctggaaacctccccgcccttcacaaccagctctgaccaggcagcgcccagtggtccgtccccgcattaacgagaagacgaatctagaagcttgagcctgcaggacaaaagctcgggctctgtgagcccgaatctcacctcggggttgcaatccagcaacagcatttcccgcctaaggcagatgacaagagtccttggaagtgcagagaggtgagacactcgccgcaccccgacaggatggtatgaagaagcattagaacagtttgaagaaatcaaggagaaagaccatcaagcaacttaccagctaggagtgatgtactatgatgggctggggaccactctagacgctactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtattttacaggtgacatgttacttcgttcttgaattcgtacgctgttaagttttgcaacttgaaacctagacacaaggtcaaattgctggaagagtcctcagaggtccacctcttaccctacagactggccgagaccatatcaagtattaaaaccattctatacagcaagtatcgtttatcctttcttaaacaccgagtctccaaaaatacttagtttagctttagtttagtaagttcagaagtagaaacaaacttatttaaaaccatcatttgaaagtttaattctttaaatttgtctcttagttttgtgaattttgaataataatgtttaaattttgtttcngtcatttaaaatttaaattttcagtcatttaaaattttaaaaatttaaaatttcacaaaactaagggtaaaagacatttaaagaattaaacttaaataagtgtgtgcagcatttctacttctgaagttattaaagctaaaactgcactaagccttttgagacatcctttattcttaaaaagctcataaataattggcttattacatataaacttcaaaaaagtgggttataagacattgctttagaatcttgcccctccaaatcttccctcaaagatcttaatgagtaaaacaactgctacatacatatgcagaatgtgtaataaaacaaaaagcaattgctatatgaaaatattcgtaagaaaagtaaagcaaattgtttctttgtgcttcagctcattttccatatttttaaaaccctgtggtaaaagcctcaatgaaatcatttacaagaactacaattaaatattgttaaaattagcaaaaggctttccgtatatagatgacatctatgaaggcaaaaggtgacagtaaaaacagtaagatccatatgcataagattgtacaaggctattcatttgtgaaacaaatatacatntcgaagacaggtctcagagataccttaactattcctttttttataaacatattaaaggatgtggctttattttataaatcacaaccatcccaacagtggatttaaacaagatttctttttagtaatgggaaaatgcaattaatatggaggtgatagtcactaagaactgttgaatggcagaaaagtatttgctctcgttttatgttctggcttgtctgtattgcctgaacttcattttgtctttgtgtaagggaagaaatttcaacagactcgggtttgagatatcctcaaatggtcatgtatttctgtctcaaatctcttaataccacccatgtaacattccttcaaccacttgaagatccaaattcccaactagtattctcttctccacacttaatccagttcctaaagattattattattattattattnttntttttttttttttgagacggagtctcctgacctaatcttagcccggcncagtggctcacgtctgtaatcccagcactttgggaggctgaggcgggcagatcatgaggtcaggagtttgagaccaggctggccaacgtggtgaaaccccgtctctactaaaaatacaaaaattagccgggcgtgatggcggacgcctgtagtcccagctactcgggaggctgagacagaagaactgcttgaaaccaggaggcagaggttgcagtgagctgagatcgcgcaaattgcactccagcctcggtgacaagagcgagactccatctcaaaaaaaaataaaaagaatcttaaaataggaacataataaaagatcggccctaagtaaagagcactttttaaactgccattaaagatgggtttcagaaatcataaactttgacgtgtgccatacatggtaacatgctatgcttatatgtcttctataaatccaatgcagaatttaaaatttcagtttactctagttaccataaagctaatgctctggcacaagcgagtccctgcaaactaccactgctgaggacagtagtaaaccccttgacctgagactgcggtgagtctgtaactcgagtgcattgagacttccagatcattactcttacacacacacacacacacacatacacacacacacactccttctctaagattccttgtagctgatatctcatggaaaaatgacattttatcataaataaatatagagacaaaataatagtgatctttctcattcgcaatgtaaacttaacagctacagtttaaatgatagcatagaattatgcctaaaatagacatttcccataattgtattgtgataagttcttcaggcttgacaacttcacattgcctctcttccttgaatgtattttatctggtcttttctatatagtcttttgaaggataatttttatcaatagccaactttgggtatttttttaagtgtcaaatatcatcatggtttgaaaaaaggataaaaaagctataactaaaaaaatcttaaggataacatttggtttactaatttttaatcatttatctttcagaacttgtttcttatcaagaagttagcaggtatgatatgtatatcatacgtatataaactggcataggttacatcctagggcatgaggggagtatctttcagggattcaaatggaatttttacctgttacttgtttaattgttttgttttcaatattcttggggattagacaggggaaggtattttattactgcataatagatggtgaaacccaggaaaattaagtacttgtgcatggccccactatcaataacacaaagtctgtactctggatctcccctaatgtccctgtggtctaaacggcttgataatacaaccgagcccctgaagtagctgccctcctctttccgctcccccatctcggccctgcccatactccaagggtcagctcccatctctcctccctaatgcctcacttcaagcactaatttggctctttctgctcactaaaaatcatatattttacagatttattttgtttctggagaaggcagcaaacttttacttccctgcagaagtagttaagtacatagtgttttctctaaaaaggcatttgataaatatttgaacagcctgtagagtttcaacctctttgagatataagtatcttaaatatcatagagcactgtgattcatttttatattttattgctttgaatgctcaaactatgggaaatctttggtaaaaataaagacaataaaatcttcacaataacttt

SEQ ID NO: 415560 - DNA, 4545 bp, Homo sapiens
  misc_feature (1700)..(1700): n is a, c, g, or t
  misc_feature (2297)..(2297): n is a, c, g, or t
  misc_feature (2730)..(2730): n is a, c, g, or t
  misc_feature (2733)..(2733): n is a, c, g, or t
  misc_feature (2781)..(2781): n is a, c, g, or t
tgccagagaagaaagcaagcaaggccgcttcctgcggctaagtggacaggcgactgcttgcagggatccgggggtgcgttgaccgaggcccctgtctccagcaaatgcttcagaccatccacctgcaggaagagaacagatccagcacccttcccacctttgtccagtcccgcgcccctccgggctggaaacctccccgcccttcacaaccagctctgaccaggcagcgcccagtggtccgtccccgcattaacgagaagacgaatctagaagcttgagcctgcaggacaaaagctcgggctctgtgagcccgaatctcacctcggggttgcaatccagcaacagcatttcccgcctaaggcagatgacaagagtccttggaagtgcagagaggtgagacactcgccgcaccccgacaggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtattttacaggtgacatgttacttcgttcttgaattcgtacgctgttaagttttgcaacttgaaacctagacacaaggtcaaattgctggaagagtcctcagaggtccacctcttaccctacagactggccgagaccatatcaagtattaaaaccattctatacagcaagtatcgtttatcctttcttaaacaccgagtctccaaaaatacttagtttagctttagtttagtaagttcagaagtagaaacaaacttatttaaaaccatcatttgaaagtttaattctttaaatttgtctcttagttttgtgaattttgaataataatgtttaaattttgtttcngtcatttaaaatttaaattttcagtcatttaaaattttaaaaatttaaaatttcacaaaactaagggtaaaagacatttaaagaattaaacttaaataagtgtgtgcagcatttctacttctgaagttattaaagctaaaactgcactaagccttttgagacatcctttattcttaaaaagctcataaataattggcttattacatataaacttcaaaaaagtgggttataagacattgctttagaatcttgcccctccaaatcttccctcaaagatcttaatgagtaaaacaactgctacatacatatgcagaatgtgtaataaaacaaaaagcaattgctatatgaaaatattcgtaagaaaagtaaagcaaattgtttctttgtgcttcagctcattttccatatttttaaaaccctgtggtaaaagcctcaatgaaatcatttacaagaactacaattaaatattgttaaaattagcaaaaggctttccgtatatagatgacatctatgaaggcaaaaggtgacagtaaaaacagtaagatccatatgcataagattgtacaaggctattcatttgtgaaacaaatatacatntcgaagacaggtctcagagataccttaactattcctttttttataaacatattaaaggatgtggctttattttataaatcacaaccatcccaacagtggatttaaacaagatttctttttagtaatgggaaaatgcaattaatatggaggtgatagtcactaagaactgttgaatggcagaaaagtatttgctctcgttttatgttctggcttgtctgtattgcctgaacttcattttgtctttgtgtaagggaagaaatttcaacagactcgggtttgagatatcctcaaatggtcatgtatttctgtctcaaatctcttaataccacccatgtaacattccttcaaccacttgaagatccaaattcccaactagtattctcttctccacacttaatccagttcctaaagattattattattattattattnttntttttttttttttgagacggagtctcctgacctaatcttagcccggcncagtggctcacgtctgtaatcccagcactttgggaggctgaggcgggcagatcatgaggtcaggagtttgagaccaggctggccaacgtggtgaaaccccgtctctactaaaaatacaaaaattagccgggcgtgatggcggacgcctgtagtcccagctactcgggaggctgagacagaagaactgcttgaaaccaggaggcagaggttgcagtgagctgagatcgcgcaaattgcactccagcctcggtgacaagagcgagactccatctcaaaaaaaaataaaaagaatcttaaaataggaacataataaaagatcggccctaagtaaagagcactttttaaactgccattaaagatgggtttcagaaatcataaactttgacgtgtgccatacatggtaacatgctatgcttatatgtcttctataaatccaatgcagaatttaaaatttcagtttactctagttaccataaagctaatgctctggcacaagcgagtccctgcaaactaccactgctgaggacagtagtaaaccccttgacctgagactgcggtgagtctgtaactcgagtgcattgagacttccagatcattactcttacacacacacacacacacacatacacacacacacactccttctctaagattccttgtagctgatatctcatggaaaaatgacattttatcataaataaatatagagacaaaataatagtgatctttctcattcgcaatgtaaacttaacagctacagtttaaatgatagcatagaattatgcctaaaatagacatttcccataattgtattgtgataagttcttcaggcttgacaacttcacattgcctctcttccttgaatgtattttatctggtcttttctatatagtcttttgaaggataatttttatcaatagccaactttgggtatttttttaagtgtcaaatatcatcatggtttgaaaaaaggataaaaaagctataactaaaaaaatcttaaggataacatttggtttactaatttttaatcatttatctttcagaacttgtttcttatcaagaagttagcaggtatgatatgtatatcatacgtatataaactggcataggttacatcctagggcatgaggggagtatctttcagggattcaaatggaatttttacctgttacttgtttaattgttttgttttcaatattcttggggattagacaggggaaggtattttattactgcataatagatggtgaaacccaggaaaattaagtacttgtgcatggccccactatcaataacacaaagtctgtactctggatctcccctaatgtccctgtggtctaaacggcttgataatacaaccgagcccctgaagtagctgccctcctctttccgctcccccatctcggccctgcccatactccaagggtcagctcccatctctcctccctaatgcctcacttcaagcactaatttggctctttctgctcactaaaaatcatatattttacagatttattttgtttctggagaaggcagcaaacttttacttccctgcagaagtagttaagtacatagtgttttctctaaaaaggcatttgataaatatttgaacagcctgtagagtttcaacctctttgagatataagtatcttaaatatcatagagcactgtgattcatttttatattttattgctttgaatgctcaaactatgggaaatctttggtaaaaataaagacaataaaatcttcacaataacttt

SEQ ID NO: 415561 - DNA, 483 bp, Homo sapiens
cgggagctcgaactctcccttagcatcagtggtttcccctcctctgctgtgcctcacgcctttcagacactgagttcctatttggcatcttcctgatccttactctgaagatccccaaatcctgaaacctaggacagctggtcttcctctgccataagctgcctggactgtgatctcacctgcactgtggacagacagcggaggaactcgcctccacactgtgttaggcatgtgtgctagtgtgaaatgcgtccaaaggcctaccgctctttcctagagatgattaatagtgctatctaggaaacacagagttcttttctgtctagtattcccttataatttcatctagtggatcacaaatacaatgatgaaactgtgcttttcttaggcattttactggcattccgaagcatgtggcaatgggaatctggagtcccagggtgcacttgggctcatgtacttgtatggacaaggcatccggca

SEQ ID NO: 415562 - DNA, 2209 bp, Homo sapiens
gtcttgaggaccatctctcccggcagcataccgtgtggcttcacactgctctgcctctctgaacctcggtttcttcatctataaaatgggaataagagtaagccacctcaatggactgtgggaggcttaagtaaattgaagtgccatgcaagtagctagcatgcagttgcagctcaatgaatattatgatggccgcagatacgatggctacagctggggcacccatttcgggtcacaaggtagggttcaatgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaatccgagaccaggagtatggccagccctgctctaggagaccggactcctcggccatggaagttgagcccaagaaactgaaagggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggcttcgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtagcctaaagctctctgtggaaaccaccttccgggagacctgaggagtgtaacgtggaggcggctacctccgtgggtgggagcccaggtcctcagtgtctctggcagacccatcggcagctctgccaggtgctccatgtgttgcccttgtatcctccttgtcaataaaggaagttccgctgcagaaggggtgtgtgctgtgttcttgacccgttgcctttctctggtactggtgtcttaccccaaagcccaatttctaaacccagtctttctctgtccccagtctcaagcagggtgtcccactggagagatctcttggcttccctaacttagtccaggaacacagccttgttcttctcttcctgaatctctgtcctgccacacatggtcccagttccctagcctggagttctagaaggatggagagtgaggggatccaggccattca

SEQ ID NO: 415563 - DNA, 2229 bp, Homo sapiens
gtcttgaggaccatctctcccggcagcataccgtgtggcttcacactgctctgcctctctgaacctcggtttcttcatctataaaatgggaataagagtaagccacctcaatggactgtgggaggcttaagtaaattgaagtgccatgcaagtagctagcatgcagttgcagctcaatgaatattatgatggccgcagatacgatggctacagctggggcacccatttcgggtcacaaggtagggttcaatgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaagggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggcttcgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtagcctaaagctctctgtggaaaccaccttccgggagacctgaggagtgtaacgtggaggcggctacctccgtgggtgggagcccaggtcctcagtgtctctggcagacccatcggcagctctgccaggtgctccatgtgttgcccttgtatcctccttgtcaataaaggaagttccgctgcagaaggggtgtgtgctgtgttcttgacccgttgcctttctctggtactggtgtcttaccccaaagcccaatttctaaacccagtctttctctgtccccagtctcaagcagggtgtcccactggagagatctcttggcttccctaacttagtccaggaacacagccttgttcttctcttcctgaatctctgtcctgccacacatggtcccagttccctagcctggagttctagaaggatggagagtgaggggatccaggccattca

SEQ ID NO: 415564 - DNA, 1176 bp, Homo sapiens
gtcttgaggaccatctctcccggcagcataccgtgtggcttcacactgctctgcctctctgaacctcggtttcttcatctataaaatgggaataagagtaagccacctcaatggactgtgggaggcttaagtaaattgaagtgccatgcaagtagctagcatgcagttgcagctcaatgaatattatgatggccgcagatacgatggctacagctggggcacccatttcgggtcacaaggtagggttcaatgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaagggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggaatgtggcacacctggctgagcgtaagaggaagcccaagttctccaaggaggagctggacattcttgtcacagaggtgacccaccatgaagcagtgctctttgggagggagaccatgcggctgtcccatgctgacagggacaagatttgggaaggcatagcccggaaaatcacctccgtcagccaggtgccccgctccgtcaaggacattaagcacagatgggatgacctgaaacggaggaccaaggacaagctggccttcatgcagcag

SEQ ID NO: 415565 - DNA, 569 bp, Homo sapiens
cagagtttcaccatgttggccaggttggtctcaaactcctgacttcgtgatccacccaccttggcctcccaaagcactgggattacaggcatgagccaccattcccagccaataaaactttatttacaagaacagctggtgggccagatttggcccaagggtcatagtttattatcccttgagctaggctgctgcctgaggttgattcaacatcccagctccagtcaacaacaaaaattctaagtctcccgcctaatgctgctgtggtgtgtcatgccaaaaaagtgggctactcaggttagaccaatgacttcagaaccacagggctcagaacaggaaggagcttctttctgcagagctgattcctggaaagccaccagcactccaccttctgcccagaaatgtgattcagtcaatagctgatgaggaaaagcaacctgcaaacattaggaagaaggagaaaaataattcagaggtgatgataccacctccaatgaacagggaagcaagttcatcagtaacaaaagtcagtgaggcaaaaaaaaaagaaacaaaaaaaaaaaaaaagg

SEQ ID NO: 415566 - DNA, 1290 bp, Homo sapiens
gttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggtttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaaggtgaggctttttttttttccagttttcttatacatttgtcttctttttttaaaaaaaaaaaa

SEQ ID NO: 415567 - DNA, 758 bp, Homo sapiens
gttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggtttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagttta

SEQ ID NO: 415568 - DNA, 280 bp, Homo sapiens
tgtttcttttctgttcaccaaatgtcttgtttattacagcctatagatcacttagatttagatccctaaaatttgctgtcactctgtaaagtgcacatagtatctgcgtatttatttttacaattttctttacaaaaattctaagaaagcttagactgcaacttttcataatatataaacaaaattccaaaatagcacagatttgactttctcatttaattatgaacagtttgggaaatgtttctcaattctgaatgcatattagaactacctgagaagc

SEQ ID NO: 415569 - DNA, 815 bp, Homo sapiens
ccagtctcactaccgttttagtcctgcagctgggtaaagccactattgtgtggaaactctcccatgtgccctgtctctacctctggacacaccagctccttcttccacctattctattcctcagttaagccaagtgatcagaagtagtattaaatgggtagataattttaacaggatgcctaatgtgaaataaggagttatttttactcttctactatagaaagcctaaggtaattcttaccatctcaaagactgagtattccatttaggtttggagaccacttgtgctgtgctgcctgatatttaccaaacttgaataagtgttcgtcaacttgatagtgaatgtaccccttctcaccttatattttgattaaatcaattaactataggtcatctaccaagaatgtaatccaagcggttgataaaacattattaggcagatagattattgattattaaattttgagcagtgcaaaaacggtatagctgcttggagttcagattcagtccctcaaagagtttatgatcactgaaatacactctgaaggtattctgaagaagttaaaaaattttagaaaacgaaatgttctgtatacaaagacaatacagtcactacgaactgcagaaagtataggaaagcagtaattgatgtagagtttagacagtcttggatcttttttagagcactaaccatggatttagactcaaaatagctgctacataatagagccctttaataatttaaaccccccttgttgaaatacaagttggactcccagtgtcaaactctagactgtagctaatgtattaaaggg

SEQ ID NO: 415570 - DNA, 1078 bp, Homo sapiens
tcgtgttctgcactttttaatataaagagtgatgttgtatttcgtgttctgcgtgctggattggttgtctcctcccagccctgagcgaggggggcgggccctctagcgggggcgcccagggagggcggaaggcggctctgcggcaggaagccccaccccggaagtcggctggccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaacaaaaaaaaacgccaatcttagaatggagtaacaaccagggtcacacaaggaggtcaagattcattaacaacaaataaaggagcagtcatccctagggcagctgcctaacagtaa

SEQ ID NO: 415571 - DNA, 449 bp, Homo sapiens
tgtaaatagagacaaggtctcgctatgttgtccagctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaacaaaaaaaaacgccaatcttagaatggagtaacaaccagggtcacacaaggaggtcaagattcattaacaacaaataaaggagcagtcatccctagggcagctgcctaacagtaa

SEQ ID NO: 415572 - DNA, 807 bp, Homo sapiens
aaataggctagtagaggccgggtgttaatcggacgaggtacatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaacaaaaaaaaacgccaatcttagaatggagtaacaaccagggtcacacaaggaggtcaagattcattaacaacaaataaaggagcagtcatccctagggcagctgcctaacagtaa

SEQ ID NO: 415573 - DNA, 546 bp, Homo sapiens
tgtaaatagagacaaggtctcgctatgttgtccagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaacaaaaaaaaacgccaatcttagaatggagtaacaaccagggtcacacaaggaggtcaagattcattaacaacaaataaaggagcagtcatccctagggcagctgcctaacagtaa

SEQ ID NO: 415574 - DNA, 673 bp, Homo sapiens
  misc_feature (46)..(46): n is a, c, g, or t
catgattccgattttaatggacctcattatagggaattttggcctncaggaccaagaattcggcacgaggtgtaaaataggcacactagtgcctactttataggcattaaatgaacccatgtttattaaccagattacctggctggggtaaacgatgtaaattattggcttctacctttacgtcagcgttttctccatctctcattttgtcatttaacacactgtgctacaatcatgtggcagcttgatcatctccactacactatgctttatttctcgacaaagctcagcacaaatggcttctgatttaacggatggacgcaggttctgcactgacttctgtttcggaaccacagtaaggctgtgcagcaggagccacgaaacccgactccacctagtgctttaagacgctactgacccgtccctttggcgaggggacaacttcgaagtatgacctggccaggaggagccacaaagcgcgattagcctcgctgcatttcaggtacaggccggcgccagccgtgcctcaccaggtccaccggctccgagcagcagcaagcccggtcggaaagcgaaagtggcctcgccatgtccagaccggccagctcccccgcctacctgaccccgccccgcagccgcacctgggtccgagtcatcgccgcggccgccacgg

SEQ ID NO: 415575 - DNA, 920 bp, Homo sapiens
tcgtgttctgcactttttaatataaagagtgatgttgtatttcgtgttctgcgtgctggattggttgtctcctcccagccctgagcgaggggggcgggccctctagcgggggcgcccagggagggcggaaggcggctctgcggcaggaagccccaccccggaagtcggctggccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcgcttgatcatctccactacactatgctttatttctcgacaaagctcagcacaaatggcttctgatttaacggatggacgcaggttctgcactgacttctgtttcggaaccacagtaaggctgtgcagcaggagccacgaaacccgactccacctagtgctttaagacgctactgacccgtccctttggcgaggggacaacttcgaagtatgacctggccaggaggagccacaaagcgcgattagcctcgctgcatttcaggtacaggccggcgccagccgtgcctcaccaggtccaccggctccgagcagcagcaagcccggtcggaaagcgaaagtggcctcgccatgtccagaccggccagctcccccgcctacctgaccccgccccgcagccgcacctgggtccgagtcatcgccgcggccgccacgg

SEQ ID NO: 415576 - DNA, 472 bp, Homo sapiens
gcggccgcctactactactactactgctcgaattcaagcttctaacgatgtacggggactgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaacaaaaaaaaacgccaatcttagaatggagtaacaaccagggtcacacaaggaggtcaagattcattaacaacaaataaaggagcagtcatccctagggcagctgcctaacagtaa

SEQ ID NO: 415577 - DNA, 1035 bp, Homo sapiens
tcgtgttctgcactttttaatataaagagtgatgttgtatttcgtgttctgcgtgctggattggttgtctcctcccagccctgagcgaggggggcgggccctctagcgggggcgcccagggagggcggaaggcggctctgcggcaggaagccccaccccggaagtcggctggccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcgggtatagcacaataagaaaccgacaaaaacagcagctgatgactcactccaacaacgcacagcaccagaaggcaaggaaatcaaacctcagaggctaaatgttccatgacttctccaagatcatgaagtaagcactgagtaagtagggagggggagcaaggactcaaccccttgctcctaatctttactctataccgcattcaggagccgccagctgtatggggaacaaggcctggatcccaccccaaagacatggattggagacccaccccttggtgaccctagacccgccaatagatcgttgtgaagctgcagtttccctatctgtaaaatgggagcatttagtccaccagcgcgaaaggcacggagggagtttccctattatatgaccgtacacgaaatctagactgtgaccaaagtctcccgctcctcagcctcctctcctccgcatcctcagccactagtcacgctggagaggaggcgtgggaactgacctccgcgggccgggcctcggcaacgcgcatcctcccacccggcctagccca

SEQ ID NO: 415578 - DNA, 362 bp, Homo sapiens
ttccttcgtcgcccacgcgtccgcaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaacaaaaaaaaacgccaatcttagaatggagtaacaaccagggtcacacaaggaggtcaagattcattaacaacaaataaaggagcagtcatccctagggcagctgcctaacagtaa

SEQ ID NO: 415579 - DNA, 880 bp, Homo sapiens
tgctggagtgcagtggcgccatctcggctcactgcacgctctgccttctgggttcatgccattctcctgcctcagcctcctgagtagctgggactacaggcacccgccaccatgcctggctaattgtttgtatttttagtagagacagggtttcaccgtgttggccaggatggtcttgatctcctgacctcgtgatccgcctgccacggcctcccaaagtgctgggattacaggcgtgagtcaccgcgcccggcggatctctgaggttttctcatggtgtaaaataggcacactagtgcctactttataggcattaaatgaacccatgtttattaaccagattacctggctggggtaaacgatgtaaattattggcttctacctttacgtcagcgttttctccatctctcattttgtcatttaacacactgtgctacaatcatgtggcagcttgatcatctccactacactatgctttatttctcgacaaagctcagcacaaatggcttctgatttaacggatggacgcaggttctgcactgacttctgtttcggaaccacagtaaggctgtgcagcaggagccacgaaacccgactccacctagtgctttaagacgctactgacccgtccctttggcgaggggacaacttcgaagtatgacctggccaggaggagccacaaagcgcgattagcctcgctgcatttcaggtacaggccggcgccagccgtgcctcaccaggtccaccggctccgagcagcagcaagcccggtcggaaagcgaaagtggcctcgccatgtccagaccggccagctcccccgcctacctgaccccgccccgcagccgcacctgggtccgagtcatcgccgcggccgccacgg

SEQ ID NO: 415580 - DNA, 273 bp, Homo sapiens
actcctgacctcaagtgatccgcctgcctcagcctcccaaagtgctgggattacaggcgtgagtcaccgcgcccggcggatctctgaggttttctcatggtgtaaaataggcacactagtgcctactttataggcattaaatgaacccatgtttattaaccagattacctggctggggtaaacgatgtaaattattggcttctacctttacgtcagcgttttctccatctctcattttgtcatttaacacactgtgctacaatcatgtggcag

SEQ ID NO: 415581 - DNA, 467 bp, Homo sapiens
ctttcatcccacaaatttcttattcagagggcactggaaaggtcggtacttagatgcccagtgaaaacccctcaccccaatctctgccctgcctgcaggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttc

SEQ ID NO: 415582 - DNA, 1559 bp, Homo sapiens
atggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415583 - DNA, 1747 bp, Homo sapiens
  misc_feature (1571)..(1571): n is a, c, g, or t
atggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaaaaaaaaaacaanaaaactccgagggacacacacaggcaggggcgggcaacaagcggcacgcacacgggaccaggcgcgcacagcggctccggaaccaaacctctctgccacaaggcggacacacgccgcgccacccaaaagggggacccaataacacaaaaccaggaccggtaggcgccccgacaaac

SEQ ID NO: 415584 - DNA, 1453 bp, Homo sapiens
agtgcaaccagaggtagtaaagaggcagtactatacggttctaaggtagcgcggctgggtgggccactcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415585 - DNA, 2225 bp, Homo sapiens
  misc_feature (1575)..(1575): n is a, c, g, or t
  misc_feature (1580)..(1580): n is a, c, g, or t
  misc_feature (1594)..(1594): n is a, c, g, or t
  misc_feature (1601)..(1601): n is a, c, g, or t
  misc_feature (1625)..(1626): n is a, c, g, or t
  misc_feature (1628)..(1628): n is a, c, g, or t
  misc_feature (1630)..(1631): n is a, c, g, or t
atggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaaaaaaaaaaaaaaaaanaaaanaaaaaaaaaaaaanaaaaaanaaaaaaaaaaaaaaaaaaaaaaannanannaaaaaaaaacaaaaaaaaaaaaaaaaaaaaaaaaaaaagagggggggcggccgacaaaaaaaaccacccccccggggggccgccccccgataggagcgccacccccggcagccgtgccagcgacgaaaacgaagggggcgcgcccccacaacaggagggcgcagcatatcaacaacaaacagcgacgcggcgcccggcgcgcctgtaacaatacaccccacgctgctcgcccaggacgcgaaaacacgaccgccgccacgacccgacgactccacgggaaggaacacagaacccaccccacacccacggcgcggcggggcgaaccacttcgggcgcgaccaccaccgccaccacccaggcagaggaaatgctaccgccccacgtggggaggaccaaacaacacacacgcactcacgcgagcagacacatcaggcgagtccacccccccacaccacacaaaccgaacgtcggcgcacgacggaaaacatcactcgtcccccccgcagcagaatcaaccgcaggagaaaaataaacacggccggagcacgtaaggcaccaaaacaccccaccacaacaacaggcagacaccacggc

SEQ ID NO: 415586 - DNA, 1966 bp, Homo sapiens
  misc_feature (1575)..(1575): n is a, c, g, or t
  misc_feature (1580)..(1580): n is a, c, g, or t
  misc_feature (1594)..(1594): n is a, c, g, or t
  misc_feature (1601)..(1601): n is a, c, g, or t
  misc_feature (1625)..(1626): n is a, c, g, or t
  misc_feature (1628)..(1628): n is a, c, g, or t
  misc_feature (1630)..(1631): n is a, c, g, or t
atggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaaaaaaaaaaaaaaaaanaaaanaaaaaaaaaaaaanaaaaaanaaaaaaaaaaaaaaaaaaaaaaannanannaaaaaaaaaaacccttggggggccgcttggcccaagccaatttaaaactgaaaaaagttaatgaagggggccaaaattgaagctaattgggcaaattcccccaaaagggaggggaataaaaataaatgggccggggttaaaaaacgtgggaacgggaaaaacccgggggtaaccaaattaaatggcttggaaaaaaatccccttttcccaagtggggaaaaaagaaaaaaggcccgaaccaatcgcctttccaaaaagtggccaaccctaaagggaaaaggaaaattgaaagcgtaaaaatttggtaaaaatccgggtaaaattttggtaaaaaa

SEQ ID NO: 415587 - DNA, 1581 bp, Homo sapiens
atggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcaggtatgaggccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415588 - DNA, 1400 bp, Homo sapiens
tgaaagcggccgagaagctacaggggagggagacctgagttctaaattaggaactcaaggattagagttttggagaggcgggagagtgaggactgagggagccgaaaagggcggtgaccggagtattctaaatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415589 - DNA, 1256 bp, Homo sapiens
agtgcaaccagaggtagtaaagaggcagtactatacggttctaaggtagcgcggctgggtgggccactcctgatccctgctgccctcgcctctttcatcctggcctttggcaccggagtggagttcgtgcgctttacctcccttcggccacttcttggagggatcccggagtctggtggtccggctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415590 - DNA, 1188 bp, Homo sapiens
agtgcaaccagaggtagtaaagaggcagtactatacggttctaaggtagcgcggctgggtgggccactcctgatccctgctgccctcgcctctttcatcctggcctttggcaccggctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415591 - DNA, 1382 bp, Homo sapiens
atggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415592 - DNA, 1079 bp, Homo sapiens
agtgcaaccagaggtagtaaagaggcagtactatacggttctaaggtagcgcggctgggtgggccactcctgatccctgctgccctcgcctctttcatcctggcctttggcaccggagtggagttcgtgcgctttacctcccttcggccacttcttggagggatcccggagtctggtggtccgggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415593 - DNA, 1170 bp, Homo sapiens
atggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacaa

SEQ ID NO: 415594 - DNA, 538 bp, Homo sapiens
cagcagaggctgccgctgcgcgtcccctaggcgcggaagaggcggctggtggtccctgacggcaaggtgaagtcgaggcagtaatcgggaacccaggttttataccttacgaataaagctggcacgtttccatttctcctgggcaaatatttagaagaaaagttgctgggtaattgaagcactgagaccacagaggcaagagctggggaaggaaaactgcccatgagatgagatgtgcctctcagcttccaaaatcggggagatgccccccatggaatccagccatcatgctgtgaggaatccaagcagctacatagaaaggccacaactagatattccagctgtagtcagctgaagctccagccaacagccaacatcaaccaccacgcgtgaaaacgagcaagccttcagatgattccgactcccaacctccaagccacctcagctgaagccaagtagagcagagactagctgtcccccaatgctctaatatgcagattcataattaaaaagaatgttattgttctaaaaaaaaaaa

SEQ ID NO: 415595 - DNA, 638 bp, Homo sapiens
cagcagaggctgccgctgcgcgtcccctaggcgcggaagaggcggctggtggtccctgacggcaaggtgaagtcgaggcagtaatcgggaacccaggttttataccttacgaataaagctggcacgtttccatttctcctgggcaaatatttagaagaaaagttgctgggtaattggtggagacaaggtttcgccacattgactgggctggtctcgaactcctgagctcaagcaaccggccctccttgacctcccaaagtgctaggattacaggtgtgaaccaccgtgcccggccctactttctatcgaagtagaataggtagatcacattattattaacagtatatgggaagagggaggtcctcccatgttacattgttctcccttcaccttctgggtcatgttgcaccactgtttcccttctagtcatatcccagggggccttgtcccatttatacagctctattctagtggtcaccagaggaatgggagtaatctgattgaaagataagacagaagattgtactctcttttttttttttttgagacagagtcacccaggctggaatgcagtggcattgtcatggctcaccgcagtctcaaactcctgggcccaagtgatcctcccactcagcctc

SEQ ID NO: 415596 - DNA, 444 bp, Homo sapiens
cagcagaggctgccgctgcgcgtcccctaggcgcggaagaggcggctggtggtccctgacggcaaggtgaagtcgaggcagtaatcgggaacccaggttttataccttacgaataaagctggcacgtttccatttctcctgggcaaatatttagaagaaaagttgctgggtaattggtggagacaaggtttcgccacattgactgggctggtctcgaactcctgagctcaagcaaccggccctccttgacctcccaaagtgctaggattacaggattaaaaatatgcatggagctgtcatcgcctatgaaaacaatgccttcttctggatacctcctgaaggacttgcctgaggctgttttacagttacttttttttttaataagtagaaggagtacagtctaaaataataatacaaatagtacaataaattacataaactagt

SEQ ID NO: 415597 - DNA, 1274 bp, Homo sapiens
tgccagccttggcctcccaaagtgctgggattacaggcgtgagccaccgcacccggccacatgtagtattaaattgtagtgagccaagattgcgccgttgcactccagcctgggagacagagtgagactccgtctaaaaaaaaaaaaaaatactacatgtgtgaattagaaattctaagctgagaaagctacttaaaattggtcaagaaaaagatacacattaagtataagaaagttggcatggctatagtagtatcagataataggcctcaaaacaatgtatatggcaggagataggtaacagtcataaaagagcaggtcattaggaatttgcatatacatttgtcactacagggatacattctgagaaatgtgttattaggtgattgcatcatgcaagcatcatagagcacactaacacaaacagcaatggggtagcctactacatacctaagttatatggtatagcctattgctcctaggctacaaacctgtatagcatattatatagcatatagcatacctgtattgaatgctgtaggcatttataacacagtggtgtttgtgtatctaaacatagcaaaggtacagtaaaaatactgtataaaatattaaaaaatggcacaccggtataagatacttgccatgaatggagcttgtgggactgaatttctgggtgcatcagtgagtgagttgtgagagaatgctaaggactaggacattactgtatactgctgtagactttacaagcagtacacttaggcttcactaaatttatttttttaagttttcttcaataataaattaaccttagcttcctgtaatatttttacattataaacttactattttttatctttctgaattgtagtaactcttcacttaaaacgcaaacacattatatagcaacacaaaaatatttctgtccttattctataggcttttttctatttaaaaatttttttgttttaaaaatgtttgttactttttaaactttcttgttaaaaacaaacacactttagcctgggcctacacagggtctagagtatcaatatgtctgtcttttaccgccatatcttgtccaactggaatgtcgtcttcaggattaaaaatatgcatggagctgtcatcgcctatgaaaacaatgccttcttctggatacctcctgaaggacttgcctgaggctgttttacagttacttttttttttaataagtagaaggagtacagtctaaaataataatacaaatagtacaataaattacataaactagt

SEQ ID NO: 415598 - DNA, 948 bp, Homo sapiens
agcgatctgcctgccttggcctcccaaagtgctgggattacaggcatgagccactgtgcctggataggtcccaatctataatcgaatgaaatcagcttcttttaatcatccgtccaccatcttttggatggtccaatacctcttcaagagctttcattttactgttccgaaaaaaaagggctgaaccgatagtggatgctaaatattaatgggaaaatagagggatccattaggagaatcttgggctgtttggcatcatcactcactggaactggggacaacttcttagatctctgttacataggacatttcaagataagataatgtttacatgatctaaaatatgactgtgtttaagaagtagagacaaacagttcaccaaaaccatggctaaaaatggttaagaacttgtcagtcttcctcaggggtcctctctttgcagaagcactgagaccacagaggcaagagctggggaaggaaaactgcccatgagatgagatgtgcctctcagcttccaaaatcggggagggttgcaaagggatgacaccatccacaccagaactgcatgaatggcatcaggaatgatcagagaccataaattccagtgagaccaataacaccatttctggtcctgcatgctcttccaaactttgccactaaccccttcaagagatgccccccatggaatccagccatcatgctgtgaggaatccaagcagctacatagaaaggccacaactagatattccagctgtagtcagctgaagctccagccaacagccaacatcaaccaccacgcgtgaaaacgagcaagccttcagatgattccgactcccaacctccaagccacctcagctgaagccaagtagagcagagactagctgtcccccaatgctctaatatgcagattcataattaaaaagaatgttattgttctaaaaaaaaaaa

SEQ ID NO: 415599 - DNA, 267 bp, Homo sapiens
gtgagaccaataacaccatttctggtcctgcatgctcttccaaactttgccactaaccccttcaagaggtacagtctatttccctttctcttgaaattgggtaggcctttgggactcccttgataaacagaatacaacagaaatgacactgtgtatctaacaaggctaggttagaaaaggcaacagaacttcatcctaatctctctcaagatgccccccatggaatccagccatcatgctgtgaggaatccaagcagctacatagaa

SEQ ID NO: 415600 - DNA, 363 bp, Homo sapiens
ttctcctttagtttaccctaatgtgtgtgagatttcatgtgtagttcatttttctttttctgaacagcactccattgtgcaaatataccacaatttgtgtagtcatttttctgttgttgaacatttggcatatttacaggttttataccttacgaataaagctggcacgtttccatttctcctgggcaaatatttagaagaaaagttgctgggtaattggtaagtttacatttaactttccaagaagctgataagccttttagaatgattagttgtgatttgtgtgtgtgagattgtgtaactggagtaagtagtttctgagtttgctttgctatgtttgtatggaattataagatgggctca

SEQ ID NO: 415601 - DNA, 356 bp, Homo sapiens
ccccttgaagaatgacaacttaattgcctaatgattggtgggtattgagcaaaataggtgtagtcacttacaaagtatttggcagtcataatttgaagactatgtactaacatgggaaaatgcttatgatatactcaagttaaaaaagaatgttttagaaatatgtgcatggcatgattattataacctaagaatttagaaataccctcaaccaaaaactaaaacctcctggaaactgtaaagaagcacaacaacatgctgttggtggttatgtgagagctatggagttctgtctcttgctctgttttttaaaaatgtgttttccaaattccatagtgtgattataatacctttac

SEQ ID NO: 415602 - DNA, 403 bp, Homo sapiens
tgattagtgcaaactctaaaatgctcatgaagggggagggaaattgaatgtgaacaaataggaaaatgatgaaaaaaacttccagtttttttaaatgtactgccaggaagaagagttgacagctataatcttcttactgataaattttctgttgtaaggctagataatgatttctagaagaaaggtaaaagaaagtagaattgttttgataagaatggggaccagtatagaagataaattaaaatgatcaaataaaggcacaggtgacaggttcgtctagtattttcaaaaatgtaaatgggcttgaactgaaatggggagaggaagatgagctccaagggcataattctggtagtagggctcattttaagctcttcttatgctcaaaaccacctgtacccaa

SEQ ID NO: 415603 - DNA, 637 bp, Homo sapiens
attgcttacatatgatgtacctgaaattatttgtccataaactttactaagtaccaactatgtccaagacattgcactaagtgctaggcaaatcattggacaaaacttctgtcctcaagaagctcatgatctatttgtaaaggagataaatatagtagcagataactattaagtaatgcaatatctaagttgatttatgagtttaaaatctgacatagtgaaattaaaaaaatcagtatttggagaaattaatgatgtccattgataaaaatattgaagctatcttattcttattcatctttcacatatcctttacttactaaaagtgactgactcccacaagttaccagtatatgtaacacagaaatccagtgttctttttcttaaaacaccagtatgttagataataattcttgaataaattctataatgctatttttaaaaaatcaactcaacactgatttcagtgaagttcaggtactccatttgggtgaattttaactggcaacgtgaaaaaaaagaaaatttggaagatgctcaaataggattgatagaggttcattttgtgtcatattttcgctttatatggatgttgatatgttctcagaataaatttataactgcaatagaaaatgga

SEQ ID NO: 415604 - DNA, 202 bp, Homo sapiens
ctttattgtgcaatttatctaataacacaattgtgtctgtaaagaaaatacaaatggagaaaagtttctgcaattattaagcagaatataaacctaaggatatataaagcatatatttatctcaatatttccatcttctctttctcaaatccaaggttttcttactctactttcaaagaacaatatatatgatgttttaaat

SEQ ID NO: 415605 - DNA, 1386 bp, Homo sapiens
ctgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatactt

SEQ ID NO: 415606 - DNA, 1638 bp, Homo sapiens
accggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtattgcgcacgattgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaactttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaaaaaaa

SEQ ID NO: 415607 - DNA, 1353 bp, Homo sapiens
gggaaagtgtgagaggaagagttggagaaaagtcgggggaaagtagggacagggttaaggggagagaggaggatgagggcggcgaggagagattaaaaggggaaggggggtcgctggagaggagggcggactgtggatcggaggtattgcgcacgattgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaactttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaaaaaaa

SEQ ID NO: 415608 - DNA, 1250 bp, Homo sapiens
caccctctctccagcattaagcagcttctgtgagatgcaggtattgcgcacgattgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaactttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaaaaaaa

SEQ ID NO: 415609 - DNA, 1605 bp, Homo sapiens
aaaaaaacaaaaccttaattatagcgcaaagaaaggccaggactgatgcagggattccttggaaatatcagttcctatcacttttaaaacctgattttggatctctctgttctatgtatgtctttagtgagagcacaatacatggcagaacgctgtgccaaatgttataggtaaggaatatagaaatgaatgttttttgttgtgaaggtgttttcatgtgatattttataaacacattttaaaaaatctccatcactttttagtataggaaggatagctttgcctgggaaaaacagtttcaacacacctgctcagagtagcagttctccctcaaaaaagcagtgttcagcctgcactgactgttctgcttgccaaaaggaggaagcatgcaagatacttatttctccatagattgtggagtatagagggatgtgggactacagattattattttttttccccgagacagagtcttgctctgtcgcccaggttggaacacaatggcacgacctcagctcactgcaacctctgtctcccgggttcaagcaattctcctgcttcagcctcctgagtagctgggattacaggcacacaccaccaccgcactcagctaatttttgtatttttagtagaggtggggttttaccatgttggccaggctggtcttaaactcctgaccttgtaatcatcccgcctcggcctcctaaagtgctaggattacaggcatgagccaccgcacccggcccagataatttttaatagcctttgatcatggggtgagtgagggagtaggtatacttggcaaatgcatggttctctgatttctagctctaaagcagccttatctgaatccccaaatcttgtgatgctgagtaccattactgaaccagtctgcacggtaggcatctgctaccaaaatttacctcctacctggtaggtgtcatctgataagaaagaagacaggttattttaattttttgagataatcacagaaaattgcagcccatactctttattaccgaattcaagtttggaaatagaccctttgttttaaatcatgatgggtctttatcccaatcatttatctgggtcatttttccaactttggagttctaggaaagaaccttgaaaacctgatatgattctgcagcatgaggtctacggtgaccatttgggcaaagctccagtggcaatcatttattgtgttttgcatttcctgggatttattgaaataagaattcactgtgattatgtagtcttctggctagtatcaggcagctctgcttttaatttggttaattttattttctctgaagagggagaagaggtacaatttaatcttggcctccacaagcatattaaagctcacgtgttaatcagtgcattcttatgctcctacattaaatgccttgggtaaatggataaatggacatgtgcccagctttaattttttttgcaacagaaagatcagacttccgtatggcatcgttggatttcagaggctttctggtgtatctgtaaatctgaatgttgccttctgccagtctgtataaccaggtgattcatgctgcaaatgaaatcaggaagcagtaaagtgttaaagca

SEQ ID NO: 415610 - DNA, 1756 bp, Homo sapiens
aaaaaaacaaaaccttaattatagcgcaaagaaaggccaggactgatgcagggattccttggaaatatcagttcctatcacttttaaaacctgattttggatctctctgttctatgtatgtctttagtgagagcacaatacatggcagaacgctgtgccaaatgttataggtaaggaatatagaaatgaatgttttttgttgtgaaggtgttttcatgtgatattttataaacacattttaaaaaatctccatcactttttagtataggaaggatagctttgcctgggaaaaacagtttcaacacacctgctcagagtagcagttctccctcaaaaaagcagtgttcagcctgcactgactgttctgcttgccaaaaggaggaagcatgcaagatacttatttctccatagattgtggagtatagagggatgtgggactacagattattattttttttccccgagacagagtcttgctctgtcgcccaggttggaacacaatggcacgacctcagctcactgcaacctctgtctcccgggttcaagcaattctcctgcttcagcctcctgagtagctgggattacaggcacacaccaccaccgcactcagctaatttttgtatttttagtagaggtggggttttaccatgttggccaggctggtcttaaactcctgaccttgtaatcatcccgcctcggcctcctaaagtgctaggattacaggcatgagccaccgcacccggcccagataatttttaatagcctttgatcatggggtgagtgagggagtaggtatacttggcaaatgcatggttctctgatttctagctctaaagcagccttatctgaatccccaaatcttgtgatgctgagtaccattactgaaccagtctgcacggtaggcatctgctaccaaaatttacctcctacctggtaggtgtcatctgataagaaagaagacaggttattttaattttttgagataatcacagaaaattgcagcccatactctttattaccgaattcaagtttggaaatagaccctttgttttaaatcatgatgggtctttatcccaatcatttatctgggtcatttttccaactttggagttctaggaaagaaccttgaaaacctgatatgattctgcagcatgaggtctacggtgaccatttgggcaaagctccagtggcaatcatttattgtgttttgcatttcctgggatttattgaaataagaattcactgtgattatgtagtcttctggctagtatcaggcagctctgcttttaatttggttaattttattttctctgaagagggagaagaggtacaatttaatcttggcctccacaagcatattaaagctcacgtgttaatcagtgcattcttatgctcctacattaaatgccttgggtaaatggataaatggacatgtgcccagctttaattttttttgcaacagaaagatcagacttccgtatggcatcgttggatttcagaggctttctggtgtatctgtaaatctgaatgttgccttctgccagtctgtataaccaggtgattcatgctgcaaatgaaatcaggaagcagtaaagtgttaaagcaagagtattgtccaattcacttgtcttcctgatccttgtactttatttcacgtgtcggtgtttacattacatacttatatttcctgtgaaagaaagagttaaataaattgtagcagtttgattttctttttcttaatgtgacattttctctt

SEQ ID NO: 415611 - DNA, 1748 bp, Homo sapiens
aaaaaaacaaaaccttaattatagcgcaaagaaaggccaggactgatgcagggattccttggaaatatcagttcctatcacttttaaaacctgattttggatctctctgttctatgtatgtctttagtgagagcacaatacatggcagaacgctgtgccaaatgttataggtaaggaatatagaaatgaatgttttttgttgtgaaggtgttttcatgtgatattttataaacacattttaaaaaatctccatcactttttagtataggaaggatagctttgcctgggaaaaacagtttcaacacacctgctcagagtagcagttctccctcaaaaaagcagtgttcagcctgcactgactgttctgcttgccaaaaggaggaagcatgcaagatacttatttctccatagattgtggagtatagagggatgtgggactacagattattattttttttccccgagacagagtcttgctctgtcgcccaggttggaacacaatggcacgacctcagctcactgcaacctctgtctcccgggttcaagcaattctcctgcttcagcctcctgagtagctgggattacaggcacacaccaccaccgcactcagctaatttttgtatttttagtagaggtggggttttaccatgttggccaggctggtcttaaactcctgaccttgtaatcatcccgcctcggcctcctaaagtgctaggattacaggcatgagccaccgcacccggcccagataatttttaatagcctttgatcatggggtgagtgagggagtaggtatacttggcaaatgcatggttctctgatttctagctctaaagcagccttatctgaatccccaaatcttgtgatgctgagtaccattactgaaccagtctgcacggtaggcatctgctaccaaaatttacctcctacctggtaggtgtcatctgataagaaagaagacaggttattttaattttttgagataatcacagaaaattgcagcccatactctttattaccgaattcaagtttggaaatagaccctttgttttaaatcatgatgggtctttatcccaatcatttatctgggtcatttttccaactttggagttctaggaaagaaccttgaaaacctgatatgattctgcagcatgaggtctacggtgaccatttgggcaaagctccagtggcaatcatttattgtgttttgcatttcctgggatttattgaaataagaattcactgtgattatgtagtcttctggctagtatcaggcagctctgcttttaatttggttaattttattttctctgaagagggagaagaggtacaatttaatcttggcctccacaagcatattaaagctcacgtgttaatcagtgcattcttatgctcctacattaaatgccttgggtaaatggataaatggacatgtgcccagctttaattttttttgcaacagaaagatcagacttccgtatggcatcgttggatttcagaggctttctggtgtatctgtaaatctgaatgttgccttctgccagtctgtataaccaggtgattcatgctgcaaatgaaatcaggaagcagtaaagtgttaaagcaagagtattgtccaattcacttgtcttcctgatccttgtactttatttcacgtgtcggtgtttacattacatacttatatttcctgtgaaagaaagagttaaataaattgtagcagtttgaaaaaaaaagtcgacgcggccgcg

SEQ ID NO: 415612 - DNA, 217 bp, Homo sapiens
gagaaaccaaacatgtttatgaaattaacacgttctgaaagattagcacatccaatctatggtaaattttagcaaattcaaaacagagtgaagcctgaactgtcattttccagcatctcatcactaagggaaggttgttttcaactggaaataactaattcctttatgctttattatttaaatttctgtttaagaataatgtgtagttattattttt

SEQ ID NO: 415613 - DNA, 443 bp, Homo sapiens
caaaagacagacaaaagcagaaatcatataatagagaatatgcttgccaaacacatgtacataatgttttctctctctccaaatttgaacaactgcttattgaaatcatacattatttattaacataattgtcaaagagaattttcaagatactcttttctaccttgttcataaatacatcttgaattatgggttgtctaaaagctaaaataaaaaatgaaagggttaattcacactaatctgatgtatggtctttaacaagttaaataatccctcattattcctccaatttaaaaatttatttctctctaacctttttatcttacctccagctagtgaactccagttagatagatgagaagtgttagataatttcttttcacaaataatctgaataaaaaagaatagaaagttattaatttctatatagtctggacattgcc
